United States Patent 7,745,391 (HUMAN THROMBOSPONDIN POLYPEPTIDE) - sequence listing, part 189

SEQ ID NO: 454381 - DNA, 8354 bp, Homo sapiens
cagtctcattgttccgaaacaggagaggcgagccttggagcgcaaaatgtcagaaatggaggaagaaatgaagaacctccaccagctaaaacagattcaaaccttgaagcagatgaacgagcaactgcaggctgagaacagggccctgacccgagtggtggccagactctcggagtccatcgagtcctcggacacccaggagctctagttcttgcccctactctccaactcacttccctcctccactactccaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctatcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcaggctgcggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccctgaggtttccatgcctctcccattttagtggtagcattttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttg

SEQ ID NO: 454382 - DNA, 4517 bp, Homo sapiens
  misc_feature (65)..(65): n is a, c, g, or t
ctatctcgaccgcgctcctgagtggaaccatctaataagcacatggtttggggaagggaaatggntaaaatgttgcaaaagagagatctgaaattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcaggctgcggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccctgaggtttccatgcctctcccattttagtggtagcattttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttg

SEQ ID NO: 454383 - DNA, 4444 bp, Homo sapiens
ggctagtcgtatgagaatatgcaaagagcctttggaattcacccatttttgccattgcccaaaagatcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcaggctgcggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccctgaggtttccatgcctctcccattttagtggtagcattttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttg

SEQ ID NO: 454384 - DNA, 11095 bp, Homo sapiens
agggagcgtgcgggcggtactactggcgggaggagtaaagatggcggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggcatgtattgatgaaaatttggacatggtgaagtttctggtggagaacagagccaatgtaaaccagcaagacaacgagggctggacaccccttcatgcagcagcttcctgtggctatctcaacatagcagagtatttcattaatcacggagccagtgtaggtattgtcaatagtgaaggtgaagttccctctgaccttgcagaagagccagccatgaaggatcttcttctggagcaagtaaagaagcaaggaattgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcagacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagataaaaagccagaagcctttgtcaatcattccaactctgaaagcaagagtagtatcacagagcagataccagcaccagctcaaaataccttctctgcctcttctgctaggaggttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcgaatttctgctctactggacaacaaagataaggagagagaaaacaaaagctatattagttcactagcaccccggaagctcaacagcacaagtgatattgaagaaaaggagaacagagaatcagctgttaatctagtgaggagtggctcctatacccggcagctatggagggatgaagcaaaaggaaatgaaatcccacagacaattgctccctccacctatgtatcaacttacttgaaaaggactcctcacaaatcccaggccgacacaacagcagagaaaacagcagacaatgtctcttctagcaccccgctctgtgtgatcaccaatcgccctcttcctagcactgccaatggggttacagctactcctgtgctctccattactggaacagattcctctgtggaagccagggagaagaggaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtggcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctatcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccctgaggtttccatgcctctcccattttagtggtagcattttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttg

SEQ ID NO: 454385 - DNA, 11076 bp, Homo sapiens
agggagcgtgcgggcggtactactggcgggaggagtaaagatggcggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggcatgtattgatgaaaatttggacatggtgaagtttctggtggagaacagagccaatgtaaaccagcaagacaacgagggctggacaccccttcatgcagcagcttcctgtggctatctcaacatagcagagtatttcattaatcacggagccagtgtaggtattgtcaatagtgaaggtgaagttccctctgaccttgcagaagagccagccatgaaggatcttcttctggagcaagtaaagaagcaaggaattgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcagacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagataaaaagccagaagcctttgtcaatcattccaactctgaaagcaagagtagtatcacagagcagataccagcaccagctcaaaataccttctctgcctcttctgctaggaggttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcgaatttctgctctactggacaacaaagataaggagagagaaaacaaaagctatattagttcactagcaccccggaagctcaacagcacaagtgatattgaagaaaaggagaacagagaatcagctgttaatctagtgaggagtggctcctatacccggcagctatggagggatgaagcaaaaggaaatgaaatcccacagacaattgctccctccacctatgtatcaacttacttgaaaaggactcctcacaaatcccaggccgacacaacagcagagaaaacagcagacaatgtctcttctagcaccccgctctgtgtgatcaccaatcgccctcttcctagcactgccaatggggttacagctactcctgtgctctccattactggaacagattcctctgtggaagccagggagaagaggaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtggcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctatcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcaggctgcggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacagggttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttg

SEQ ID NO: 454386 - DNA, 2371 bp, Homo sapiens
agactctcttctttgagttcttaaagtcactcaaagaagagagcatagagccagtaaaatctttagaaccagagatcctagaatcactgaagtctgcgggaagttcgacggagactctcttcctgcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcaggctgcggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccctgaggtttccatgcctctcccattttagtggtagcattttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttg

SEQ ID NO: 454387 - DNA, 8332 bp, Homo sapiens
agggagcgtgcgggcggtactactggcgggaggagtaaagatggcggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggcatgtattgatgaaaatttggacatggtgaagtttctggtggagaacagagccaatgtaaaccagcaagacaacgagggctggacaccccttcatgcagcagcttcctgtggctatctcaacatagcagagtatttcattaatcacggagccagtgtaggtattgtcaatagtgaaggtgaagttccctctgaccttgcagaagagccagccatgaaggatcttcttctggagcaagtaaagaagcaaggaattgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcagacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagataaaaagccagaagcctttgtcaatcattccaactctgaaagcaagagtagtatcacagagcagataccagcaccagctcaaaataccttctctgcctcttctgctaggaggttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcgaatttctgctctactggacaacaaagataaggagagagaaaacaaaagctatattagttcactagcaccccggaagctcaacagcacaagtgatattgaagaaaaggagaacagagaatcagctgttaatctagtgaggagtggctcctatacccggcagctatggagggatgaagcaaaaggaaatgaaatcccacagacaattgctccctccacctatgtatcaacttacttgaaaaggactcctcacaaatcccaggccgacacaacagcagagaaaacagcagacaatgtctcttctagcaccccgctctgtgtgatcaccaatcgccctcttcctagcactgccaatggggttacagctactcctgtgctctccattactggaacagattcctctgtggaagccagggagaagaggaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtggcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctatcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcctttcggagaagagggatcctcagagtcac

SEQ ID NO: 454388 - DNA, 8649 bp, Homo sapiens
agggagcgtgcgggcggtactactggcgggaggagtaaagatggcggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggcatgtattgatgaaaatttggacatggtgaagtttctggtggagaacagagccaatgtaaaccagcaagacaacgagggctggacaccccttcatgcagcagcttcctgtggctatctcaacatagcagagtatttcattaatcacggagccagtgtaggtattgtcaatagtgaaggtgaagttccctctgaccttgcagaagagccagccatgaaggatcttcttctggagcaagtaaagaagcaaggaattgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcagacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagataaaaagccagaagcctttgtcaatcattccaactctgaaagcaagagtagtatcacagagcagataccagcaccagctcaaaataccttctctgcctcttctgctaggaggttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcgaatttctgctctactggacaacaaagataaggagagagaaaacaaaagctatattagttcactagcaccccggaagctcaacagcacaagtgatattgaagaaaaggagaacagagaatcagctgttaatctagtgaggagtggctcctatacccggcagctatggagggatgaagcaaaaggaaatgaaatcccacagacaattgctccctccacctatgtatcaacttacttgaaaaggactcctcacaaatcccaggccgacacaacagcagagaaaacagcagacaatgtctcttctagcaccccgctctgtgtgatcaccaatcgccctcttcctagcactgccaatggggttacagctactcctgtgctctccattactggaacagattcctctgtggaagccagggagaagaggaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtggcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctatcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccactcataggacagatgaatcagtgtatcggccagtaccacgctgtgatgtcatgtctgttgactctacagatacccccagagtaattctcccataacgacgacgatcaatctcttaagtatcctgagatccccatc

SEQ ID NO: 454389 - DNA, 7642 bp, Homo sapiens
agggagcgtgcgggcggtactactggcgggaggagtaaagatggcggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggcatgtattgatgaaaatttggacatggtgaagtttctggtggagaacagagccaatgtaaaccagcaagacaacgagggctggacaccccttcatgcagcagcttcctgtggctatctcaacatagcagagtatttcattaatcacggagccagtgtaggtattgtcaatagtgaaggtgaagttccctctgaccttgcagaagagccagccatgaaggatcttcttctggagcaagtaaagaagcaaggaattgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcagacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagataaaaagccagaagcctttgtcaatcattccaactctgaaagcaagagtagtatcacagagcagataccagcaccagctcaaaataccttctctgcctcttctgctaggaggttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcgaatttctgctctactggacaacaaagataaggagagagaaaacaaaagctatattagttcactagcaccccggaagctcaacagcacaagtgatattgaagaaaaggagaacagagaatcagctgttaatctagtgaggagtggctcctatacccggcagctatggagggatgaagcaaaaggaaatgaaatcccacagacaattgctccctccacctatgtatcaacttacttgaaaaggactcctcacaaatcccaggccgacacaacagcagagaaaacagcagacaatgtctcttctagcaccccgctctgtgtgatcaccaatcgccctcttcctagcactgccaatggggttacagctactcctgtgctctccattactggaacagattcctctgtggaagccagggagaagaggaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtggcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctatcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctccagcctgggtgacagagcaagactccatctcaaaaaaaataataataataat

SEQ ID NO: 454390 - DNA, 7555 bp, Homo sapiens
agggagcgtgcgggcggtactactggcgggaggagtaaagatggcggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggcatgtattgatgaaaatttggacatggtgaagtttctggtggagaacagagccaatgtaaaccagcaagacaacgagggctggacaccccttcatgcagcagcttcctgtggctatctcaacatagcagagtatttcattaatcacggagccagtgtaggtattgtcaatagtgaaggtgaagttccctctgaccttgcagaagagccagccatgaaggatcttcttctggagcaagtaaagaagcaaggaattgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcagacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagataaaaagccagaagcctttgtcaatcattccaactctgaaagcaagagtagtatcacagagcagataccagcaccagctcaaaataccttctctgcctcttctgctaggaggttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcgaatttctgctctactggacaacaaagataaggagagagaaaacaaaagctatattagttcactagcaccccggaagctcaacagcacaagtgatattgaagaaaaggagaacagagaatcagctgttaatctagtgaggagtggctcctatacccggcagctatggagggatgaagcaaaaggaaatgaaatcccacagacaattgctccctccacctatgtatcaacttacttgaaaaggactcctcacaaatcccaggccgacacaacagcagagaaaacagcagacaatgtctcttctagcaccccgctctgtgtgatcaccaatcgccctcttcctagcactgccaatggggttacagctactcctgtgctctccattactggaacagattcctctgtggaagccagggagaagaggaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtggcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctatcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactcagcctgggtgacagagcaagactccatctcaaaaaaaataataataataat

SEQ ID NO: 454391 - DNA, 3139 bp, Homo sapiens
agggagcgtgcgggcggtactactggcgggaggagtaaagatggcggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggcatgtattgatgaaaatttggacatggtgaagtttctggtggagaacagagccaatgtaaaccagcaagacaacgagggctggacaccccttcatgcagcagcttcctgtggctatctcaacatagcagagtatttcattaatcacggagccagtgtaggtattgtcaatagtgaaggtgaagttccctctgaccttgcagaagagccagccatgaaggatcttcttctggagcaagtaaagaagcaaggaattgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcagacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagataaaaagccagaagcctttgtcaatcattccaactctgaaagcaagagtagtatcacagagcagataccagcaccagctcaaaataccttctctgcctcttctgctaggaggttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcgaatttctgctctactggacaacaaagataaggagagagaaaacaaaagctatattagttcactagcaccccggaagctcaacagcacaagtgatattgaagaaaaggagaacagagaatcagctgttaatctagtgaggagtggctcctatacccggcagctatggagggatgaagcaaaaggaaatgaaatcccacagacaattgctccctccacctatgtatcaacttacttgaaaaggactcctcacaaatcccaggccgacacaacagcagagaaaacagcagacaatgtctcttctagcaccccgctctgtgtgatcaccaatcgccctcttcctagcactgccaatggggttacagctactcctgtgctctccattactggaacagattcctctgtggaagccagggagaagaggaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtggcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaaggtatgaagagattttctttctttttgtatgcctgttctctgaatgcctgccaagactggatatttgagcataggcctgccccctccagatttcactacaaactcaatat

SEQ ID NO: 454392 - DNA, 1843 bp, Homo sapiens
agggagcgtgcgggcggtactactggcgggaggagtaaagatggcggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggcatgtattgatgaaaatttggacatggtgaagtttctggtggagaacagagccaatgtaaaccagcaagacaacgagggctggacaccccttcatgcagcagcttcctgtggctatctcaacatagcagagtatttcattaatcacggagccagtgtaggtattgtcaatagtgaaggtgaagttccctctgaccttgcagaagagccagccatgaaggatcttcttctggagcaagtaaagaagcaaggaattgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcagacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagataaaaagccagaagcctttgtcaatcattccaactctgaaagcaagagtagtatcacagagcagataccagcaccagctcaaaataccttctctgcctcttctgctaggaggttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcgaatttctgctctactggacaacaaagataaggtgcagtttgggagggtatgggggaattccaaggcagttttttttttccatgaaaattcaatcttaggaacaaatgaaaatattttctagtccttaagttgattttggaaatgcaaagtctttaaagagagagaggcacactgatagtttattcaagtagctatttgcttgctattgtttgcttgaccaaaaaagaaaataaaaaagctttaaaaat

SEQ ID NO: 454393 - DNA, 181 bp, Homo sapiens
atccatcaagatgtgaaactcgcaagtttggtgcagagaaggtacatgggtttccttcttttctcatctgtattcccttttctgcaattattttctttgccacatactagccagcaaaccaggcacctttgccagagccattaagctacaaaaatacttaatattttaatttgaactctgc

SEQ ID NO: 454394 - DNA, 1045 bp, Homo sapiens
agggagcgtgcgggcggtactactggcgggaggagtaaagatggcggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggtaactcctttcttggtcttagaggcgtccagtctcctacagatgcgcctttgaccctgcgagccaccccatggggagtatcagtgttgccgccgactccttctgcatggacactgcccttttgggctaatcggtttcattcttggccagcttcctccactaatcaagtctttttctgaccccagggtcttaggaatagcgtcaccccgctgcttggtcagtgtttgtatttccctccacctacttgtgttgtcatggttactggtgatttttgtccctggtcttatccctgtagattagttatcttcacttatgtctggttggcgtgcctgcacaccgcgtcactcataggcacagtgtcatttgtttgatgccctttcagaaaattcagttgttgtgtgtccccgttatagaatatcttatatcacttaaagagtaaagccctttactgggtaaagacaagcaggtctgaaaccacacctcttgttttgttgatttgtagtacttcaaaacagtttgtgttgcctctaggctacagctcctagaacacgctggacctcgttgttttaggtatcttaacttcctt

SEQ ID NO: 454395 - DNA, 2349 bp, Homo sapiens
gttgctggtacaatctcataaaatgggctccagtgtttagagaaggacagtcagaggagtggccacctgtttgttgaaaattgggcttctgggaaagttgctgcacaagtgtgtggcaaggtgtgtctgaggtagcttgacctgctttcacctggaatgatttgatctggcaatagagttccttgccattcctggttttatggaaatcagaggcacaggaagttgatctgggtgttctggggaattgagacaagcctctgccatagtttgttagtactctgtgtttggaggctaactccagtgtgctgagttgagacatcagcaagtgctgggcctggaatgtcagaagcagcaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtggcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaagaacctccaccagctaaaacagattcaaaccttgaagcagatgaacgagcaactgcaggctgagaacagggccctgacccgagtggtggccagactctcggagtccatcgagtcctcggacacccaggagctctagttcttgcccctactctccaactcacttccctcctccactactccaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctatcaacacccagtaatctccctaactagttttaacccttattcctccctcatacctagcctaggacacagcctcgtgtttttgattttagagcagcaggaggaggacagcggcaggaggaggacctggaaa

SEQ ID NO: 454396 - DNA, 9487 bp, Homo sapiens
agggagcgtgcgggcggtactactggcgggaggagtaaagatggcggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggcatgtattgatgaaaatttggacatggtgaagtttctggtggagaacagagccaatgtaaaccagcaagacaacgagggctggacaccccttcatgcagcagcttcctgtggctatctcaacatagcagagtatttcattaatcacggagccagtgtaggtattgtcaatagtgaaggtgaagttccctctgaccttgcagaagagccagccatgaaggatcttcttctggagcaagtaaagaagcaaggaattgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcagacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagataaaaagccagaagcctttgtcaatcattccaactctgaaagcaagagtagtatcacagagcagataccagcaccagctcaaaataccttctctgcctcttctgctaggaggttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcgaatttctgctctactggacaacaaagataaggagagagaaaacaaaagctatattagttcactagcaccccggaagctcaacagcacaagtgatattgaagaaaaggagaacagagaatcagctgttaatctagtgaggagtggctcctatacccggcagctatggagggatgaagcaaaaggaaatgaaatcccacagacaattgctccctccacctatgtatcaacttacttgaaaaggactcctcacaaatcccaggccgacacaacagcagagaaaacagcagacaatgtctcttctagcaccccgctctgtgtgatcaccaatcgccctcttcctagcactgccaatggggttacagctactcctgtgctctccattactggaacagattcctctgtggaagccagggagaagaggaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtggcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctatcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagagcgggtacaagcacttattatagtaagtttgaaaactggagtttattccaaaaagtagaaaaactgcttagtactttgtctatgtcttccggcgctgctgttgcatatggtttaatatagatagttgatgt

SEQ ID NO: 454397 - DNA, 10654 bp, Homo sapiens
agggagcgtgcgggcggtactactggcgggaggagtaaagatggcggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggcatgtattgatgaaaatttggacatggtgaagtttctggtggagaacagagccaatgtaaaccagcaagacaacgagggctggacaccccttcatgcagcagcttcctgtggctatctcaacatagcagagtatttcattaatcacggagccagtgtaggtattgtcaatagtgaaggtgaagttccctctgaccttgcagaagagccagccatgaaggatcttcttctggagcaagtaaagaagcaaggaattgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcagacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagataaaaagccagaagcctttgtcaatcattccaactctgaaagcaagagtagtatcacagagcagataccagcaccagctcaaaataccttctctgcctcttctgctaggaggttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcgaatttctgctctactggacaacaaagataaggagagagaaaacaaaagctatattagttcactagcaccccggaagctcaacagcacaagtgatattgaagaaaaggagaacagagaatcagctgttaatctagtgaggagtggctcctatacccggcagctatggagggatgaagcaaaaggaaatgaaatcccacagacaattgctccctccacctatgtatcaacttacttgaaaaggactcctcacaaatcccaggccgacacaacagcagagaaaacagcagacaatgtctcttctagcaccccgctctgtgtgatcaccaatcgccctcttcctagcactgccaatggggttacagctactcctgtgctctccattactggaacagattcctctgtggaagccagggagaagaggaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtggcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctatcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttgtttatagcttaaaacagaagtgtgtcttcccagcacaaacctaatcaatcagtgtatcagtgcatccttcttggagaagctacagcctgtgctcagttgagtggttcacactcagactttggctttatggttttccttcctccttgtctttgccctgaccttgatcaacaggggtgaaaagaaccaccctgaggtttccatgcctctcccattttagtggtagcattttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttg

SEQ ID NO: 454398 - DNA, 9467 bp, Homo sapiens
gttgctggtacaatctcataaaatgggctccagtgtttagagaaggacagtcagaggagtggccacctgtttgttgaaaattgggcttctgggaaagttgctgcacaagtgtgtggcaaggtgtgtctgaggtagcttgacctgctttcacctggaatgatttgatctggcaatagagttccttgccattcctggttttatggaaatcagaggcacaggaagttgatctgggtgttctggggaattgagacaagcctctgccatagtttgttagtactctgtgtttggaggctaactccagtgtgctgagttgagacatcagcaagtgctgggcctggaatgtcagaagcagcaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtggcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctatcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcaggctgcggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccctgaggtttccatgcctctcccattttagtggtagcattttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttg

SEQ ID NO: 454399 - DNA, 478 bp, Homo sapiens
ggggcaggggcgccctcgggctttgacgacgccccgtcccgctgggccaggtcgtccatccgcaacgtgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtatatacgtgttctatagagcctggcgtctggacgccgagggcagccccgacccctgtccagcgcggctcccgccaccctcaataaatgttgcttggagtggaccgag

SEQ ID NO: 454400 - DNA, 338 bp, Homo sapiens
aaaaaaaaaaacccccccagggcggcggggtccataaaccccgggaccccctctaaaggggaggggggaagagagggtttttaacccaacaccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtatatacgtgttctatagagcctggcgtctggacgccgagggcagccccgacccctgtccagcgcggctcccgccaccctcaataaatgttgcttggagtggaccgag

SEQ ID NO: 454401 - DNA, 1341 bp, Homo sapiens
ttaaggcgcagcctggaagtgccagggagcactggaggccacccagtcatgggggacaccttcatccgtcacatcgccctgctgggctttgagaagcgcttcgtacccagccagcactatgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccaccagggcacacttaccgagtactgcggcacgctcatgagcctgcccaccaagatctcccgctgtccccacctccttgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtggagaagagcgagagcggttggtggttctgtcagatgaaagcaaagcgaggctggatcccagcatccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggaaagacgacgtcacaggctacttcccgtccatgtacctgcaaaagtcagggcaagacgtgtcccaggcccaacgccagatcaagcggggggcgccgccccgcaggtcgtccatccgcaacgtgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtatatacgtgttctatagagcctggcgtctggacgccgagggcagccccgacccctgtccagcgcggctcccgccaccctcaataaatgttgcttggagtggaccgag

SEQ ID NO: 454402 - DNA, 1488 bp, Homo sapiens
  misc_feature (18)..(18): n is a, c, g, or t
  misc_feature (21)..(22): n is a, c, g, or t
  misc_feature (25)..(25): n is a, c, g, or t
aaggctaggtacgaggcnggnntgnaatcggccgaccagtcatgggggacaccttcatccgtcacatcgccctgctgggctttgagaagcgcttcgtacccagccagcactatgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccaccagggcacacttaccgagtactgcggcacgctcatgagcctgcccaccaagatctcccgctgtccccacctccttgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtggagaagagcgagagcggttggtggttctgtcagatgaaagcaaagcgaggctggatcccagcatccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggtcattcacaagctcctggacggctggtgggtcatcagcaaatacctgtcccctgcggtgacctggatctgctaacctccacccctgcctagactgtggaaggattgctggaagggtctcagttgcacagaccaggaaactgaggcccacagaggaaagacgacgtcacaggctacttcccgtccatgtacctgcaaaagtcagggcaagacgtgtcccaggcccaacgccagatcaagcggggggcgccgccccgcaggtcgtccatccgcaacgtgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtatatacgtgttctatagagcctggcgtctggacgccgagggcagccccgacccctgtccagcgcggctcccgccaccctcaataaatgttgcttggagtggaccgag

SEQ ID NO: 454403 - DNA, 1676 bp, Homo sapiens
ttaaggcgcagcctggaagtgccagggagcactggaggccacccagtcatgggggacaccttcatccgtcacatcgccctgctgggctttgagaagcgcttcgtacccagccagcactatgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccaccagggcacacttaccgagtactgcggcacgctcatgagcctgcccaccaagatctcccgctgtccccacctccttgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtggagaagagcgagagcggttggtggttctgtcagatgaaagcaaagcgaggctggatcccagcatccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggaaagacgacgtcacaggctacttcccgtccatgtacctgcaaaagtcagggcaagacgtgtcccaggcccaacgccagatcaagcggggggcgccgccccgcaggtcgtccatccgcaacgtgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtatatacgtgttctatagagcctggcgtctggacgccgagggcagccccgacccctgtccagcgcggctcccgccaccctcaataaatgttgcttggagtggaccgagaaaaaaaaaaaaaagaaaaaaaagaaaacagacaagagcacaaacacaaaacagaagtacacaagactggggcgcggacgcgacagcagaagtagcacacgaccggagggcgggcacaacacagaaacacacgccgacaacgcgagcgcggtacgcgagagaccagaacggtgggccccactcagcggagagacggagataacataacaaagacgacgagacacagagcaaaagcaaccgacagggcgaggcggcaccacgcggcgagacgagacactcgaagaccggaaaaccacaagcggacgggggaggacataggcgagccagaaacccac

SEQ ID NO: 454404 - DNA, 1581 bp, Homo sapiens
  misc_feature (18)..(18): n is a, c, g, or t
  misc_feature (21)..(22): n is a, c, g, or t
  misc_feature (25)..(25): n is a, c, g, or t
aaggctaggtacgaggcnggnntgnaatcggccgaccagtcatgggggacaccttcatccgtcacatcgccctgctgggctttgagaagcgcttcgtacccagccagcactatgtacatgttcctggtgaaatggcaggacctgtcggagaaggtggtctaccggcgcttcaccgagatctacgagttccatagatgggatttcgctatgttgcccaggctggtctctaactcctggactcaagtgatcctcccgcctcagcttcccaaattgctaggattacagaaaaccttaaaagaaatgttccctattgaggcaggggcgatcaatccagagaacaggatcatcccccacctcccagctcccaagtggtttgacgggcagcgggccgccgagaaccaccagggcacacttaccgagtactgcggcacgctcatgagcctgcccaccaagatctcccgctgtccccacctccttgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtggagaagagcgagagcggttggtggttctgtcagatgaaagcaaagcgaggctggatcccagcatccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggtcattcacaagctcctggacggctggtgggtcatcagcaaatacctgtcccctgcggtgacctggatctgctaacctccacccctgcctagactgtggaaggattgctggaagggtctcagttgcacagaccaggaaactgaggcccacagaggaaagacgacgtcacaggctacttcccgtccatgtacctgcaaaagtcagggcaagacgtgtcccaggcccaacgccagatcaagcggggggcgccgccccgcaggtcgtccatccgcaacgtgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtatatacgtgttctatagagcctggcgtctggacgccgagggcagccccgacccctgtccagcgcggctcccgccaccctcaataaatgttgcttggagtggaccgag

SEQ ID NO: 454405 - DNA, 1823 bp, Homo sapiens
  misc_feature (18)..(18): n is a, c, g, or t
  misc_feature (21)..(22): n is a, c, g, or t
  misc_feature (25)..(25): n is a, c, g, or t
aaggctaggtacgaggcnggnntgnaatcggccgaccagtcatgggggacaccttcatccgtcacatcgccctgctgggctttgagaagcgcttcgtacccagccagcactatgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccaccagggcacacttaccgagtactgcggcacgctcatgagcctgcccaccaagatctcccgctgtccccacctccttgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtggagaagagcgagagcggttggtggttctgtcagatgaaagcaaagcgaggctggatcccagcatccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggtcattcacaagctcctggacggctggtgggtcatcagcaaatacctgtcccctgcggtgacctggatctgctaacctccacccctgcctagactgtggaaggattgctggaagggtctcagttgcacagaccaggaaactgaggcccacagaggaaagacgacgtcacaggctacttcccgtccatgtacctgcaaaagtcagggcaagacgtgtcccaggcccaacgccagatcaagcggggggcgccgccccgcaggtcgtccatccgcaacgtgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtatatacgtgttctatagagcctggcgtctggacgccgagggcagccccgacccctgtccagcgcggctcccgccaccctcaataaatgttgcttggagtggaccgagaaaaaaaaaaaaaagaaaaaaaagaaaacagacaagagcacaaacacaaaacagaagtacacaagactggggcgcggacgcgacagcagaagtagcacacgaccggagggcgggcacaacacagaaacacacgccgacaacgcgagcgcggtacgcgagagaccagaacggtgggccccactcagcggagagacggagataacataacaaagacgacgagacacagagcaaaagcaaccgacagggcgaggcggcaccacgcggcgagacgagacactcgaagaccggaaaaccacaagcggacgggggaggacataggcgagccagaaacccac

SEQ ID NO: 454406 - DNA, 922 bp, Homo sapiens
gaagaaagcatagaatttggtggcttggaggtaggcaaaggttcgtaggagacagaaggcagttaacataaaagaaaaattggcaaatataatctgccagtgtcttcttttttctttaattttttcgggaggtagagataggggtcttgctatgttacccaggctgatctccaactcctggcctcaagcgatcctcccacctagatccctcaaagtactgggattacaggcgtgagcgaccgtgccctgcccattcttgccaatgtcttatagcaaatacctgtcccctgcggtgacctggatctgctaacctccacccctgcctagactgtggaaggattgctggaagggtctcagttgcacagaccaggaaactgaggcccacagaggaaagacgacgtcacaggctacttcccgtccatgtacctgcaaaagtcagggcaagacgtgtcccaggcccaacgccagatcaagcggggggcgccgccccgcaggtcgtccatccgcaacgtgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtatatacgtgttctatagagcctggcgtctggacgccgagggcagccccgacccctgtccagcgcggctcccgccaccctcaataaatgttgcttggagtggaccgag

SEQ ID NO: 454407 - DNA, 384 bp, Homo sapiens
  misc_feature (18)..(18): n is a, c, g, or t
  misc_feature (21)..(22): n is a, c, g, or t
  misc_feature (25)..(25): n is a, c, g, or t
aaggctaggtacgaggcnggnntgnaatcggccgaccagtcatgggggacaccttcatccgtcacatcgccctgctgggctttgagaagcgcttcgtacccagccagcactatgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccaccagggcacacttaccgagtactgcggcacgctcatgagcctgcccacgcataaggtgggagggatcctctaggca

SEQ ID NO: 454408 - DNA, 912 bp, Homo sapiens
ttaaggcgcagcctggaagtgccagggagcactggaggccacccagtcatgggggacaccttcatccgtcacatcgccctgctgggctttgagaagcgcttcgtacccagccagcactatgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccaccagggcacacttaccgagtactgcggcacgctcatgagcctgcccaccaagatctcccgctgtccccacctccttgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtggagaagagcgagagcggtcagacctcccaccttacggggctccttcccctggtgctcaggaacccacagccacaagccccctgccaaggctcaggcagcctggcccctgggaggactccagctctgttaggggccctaaatgtcctccccacactgtgggtcgccttctctcttagtgtgcaccctgtggtggctgtgggcatctgtgcatggcaggccggggcggggcatgtctgcgtgttctgtctggatgggtatgggaccgtctgttcattatgaagtgtgctcgcgccgaaaggattctgtga

SEQ ID NO: 454409 - DNA, 1372 bp, Homo sapiens
  misc_feature (18)..(18): n is a, c, g, or t
  misc_feature (21)..(22): n is a, c, g, or t
  misc_feature (25)..(25): n is a, c, g, or t
aaggctaggtacgaggcnggnntgnaatcggccgaccagtcatgggggacaccttcatccgtcacatcgccctgctgggctttgagaagcgcttcgtacccagccagcactatgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccaccagggcacacttaccgagtactgcggcacgctcatgagcctgcccaccaagatctcccgctgtccccacctccttgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtggagaagagcgagagcggttggtggttctgtcagatgaaagcaaagcgaggctggatcccagcatccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggtcattcacaagctcctggacggctggtgggtcatcaggaaagacgacgtcacaggctacttcccgtccatgtacctgcaaaagtcagggcaagacgtgtcccaggcccaacgccagatcaagcggggggcgccgccccgcaggtcgtccatccgcaacgtgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtatatacgtgttctatagagcctggcgtctggacgccgagggcagccccgacccctgtccagcgcggctcccgccaccctcaataaatgttgcttggagtggaccgag

SEQ ID NO: 454410 - DNA, 1401 bp, Homo sapiens
ttaaggcgcagcctggaagtgccagggagcactggaggccacccagtcatgggggacaccttcatccgtcacatcgccctgctgggctttgagaagcgcttcgtacccagccagcactatgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccaccagggcacacttaccgagtactgcggcacgctcatgagcctgcccaccaagatctcccgctgtccccacctccttgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtggagaagagcgagagcggttggtggttctgtcagatgaaagcaaagcgaggctggatcccagcatccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggaaagacgacgtcacaggctacttcccgtccatgtacctgcaaaagtcagggcaagacgtgtcccaggcccaacgccagatcaagcggggggcgccgccccgcaggtcgtccatccgcaacgtgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtatatacgtgttctatagagcctggcgtctggacgccgagggcagccccgacccctgtccagcgcggctcccgccaccctcaataaatgttgcttggagtggaccgaggctctgcaggaatgcagggagggccgggctccgccccagggttatttctaagttgaaaca

SEQ ID NO: 454411 - DNA, 1456 bp, Homo sapiens
  misc_feature (18)..(18): n is a, c, g, or t
  misc_feature (21)..(22): n is a, c, g, or t
  misc_feature (25)..(25): n is a, c, g, or t
aaggctaggtacgaggcnggnntgnaatcggccgaccagtcatgggggacaccttcatccgtcacatcgccctgctgggctttgagaagcgcttcgtacccagccagcactatacagagtcttgatctgttgcccaggccagagtgcagtggcacgatctcagctcactgcaacctccgccttccaggttcaactggttctcctgcctcagcctccagagtagttgggattacaggtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccaccagggcacacttaccgagtactgcggcacgctcatgagcctgcccaccaagatctcccgctgtccccacctccttgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtggagaagagcgagagcggttggtggttctgtcagatgaaagcaaagcgaggctggatcccagcatccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggaaagacgacgtcacaggctacttcccgtccatgtacctgcaaaagtcagggcaagacgtgtcccaggcccaacgccagatcaagcggggggcgccgccccgcaggtcgtccatccgcaacgtgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtatatacgtgttctatagagcctggcgtctggacgccgagggcagccccgacccctgtccagcgcggctcccgccaccctcaataaatgttgcttggagtggaccgag

SEQ ID NO: 454412 - DNA, 1219 bp, Homo sapiens
  misc_feature (56)..(56): n is a, c, g, or t
ttttggattcattcagcatttattgtagcaaagagtgggtagggacaccgggagancttggtgcggcacgctcatgagcctgcccaccaagatctcccgctgtccccacctccttgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtggagaagagcgagagcggttggtggttctgtcagatgaaagcaaagcgaggctggatcccagcatccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggtcattcacaagctcctggacggctggtgggtcatcagcaaatacctgtcccctgcggtgacctggatctgctaacctccacccctgcctagactgtggaaggattgctggaagggtctcagttgcacagaccaggaaactgaggcccacagaggaaagacgacgtcacaggctacttcccgtccatgtacctgcaaaagtcagggcaagacgtgtcccaggcccaacgccagatcaagcggggggcgccgccccgcaggtcgtccatccgcaacgtgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtatatacgtgttctatagagcctggcgtctggacgccgagggcagccccgacccctgtccagcgcggctcccgccaccctcaataaatgttgcttggagtggaccgag

SEQ ID NO: 454413 - DNA, 663 bp, Homo sapiens
  misc_feature (18)..(18): n is a, c, g, or t
  misc_feature (21)..(22): n is a, c, g, or t
  misc_feature (25)..(25): n is a, c, g, or t
aaggctaggtacgaggcnggnntgnaatcggccgaccagtcatgggggacaccttcatccgtcacatcgccctgctgggctttgagaagcgcttcgtacccagccagcactatgtacatgttcctggtgaaatggcaggacctgtcggagaaggtggtctaccggcgcttcaccgagatctacgagttccatgacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtggagaagagcgagagcggtcagacctcccaccttacggggctccttcccctggtgctcaggaacccacagccacaagccccctgccaaggctcaggcagcctggcccctgggaggactccagctctgttaggggccctaaatgtcctccccacactgtgggtcgccttctctcttagtgtgcaccctgtggtggctgtgggcatctgtgcatggcaggccggggcggggcatgtctgcgtgttctgtctggatgggtatgggaccgtctgttcattatgaagtgtgctcgcgccgaaaggattctgtga

SEQ ID NO: 454414 - DNA, 492 bp, Homo sapiens
aaatccatgtcaaaatcacagcattctatacacacaacagacaacagagagccaaatatgagtgactccattccaatgcttcaaagagaataaatactaggaatcaacttcaagggatgtgaaggacccttcaaggagaactcaaaccactgctcaaggaaataaaagaggacacaaacaaatggaagaacattccatgctcatgggtaggaagaatcaatagtgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccatgacatcccagaagaggacagtgaattactcctaggtcggctcttatagagtggccatagtgttctgtcaaaacacttgcttccattttcagagataaaaatcattgattacaaaa

SEQ ID NO: 454415 - DNA, 173 bp, Homo sapiens
gcggccgcctactactactactgctcgaattcaagcttctaacgatgtacggggccatgacatcccagaagaggacagtgaattactcctaggtcggctcttatagagtggccatagtgttctgtcaaaacacttgcttccattttcagagataaaaatcattgattacaaaa

SEQ ID NO: 454416 - DNA, 3893 bp, Homo sapiens
ccgcgcggcgcgggggcggggcctacgcgcggtggcgggggcggtggcggctgcccgcgcccctcccccgcacggcgctcagtgccaggctggaggcggcagcggttggaggcttcgcccggctttgcagcggggacttcggcggcggcgcctcaggcacctcggcccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtaccctttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcgcagacctctgctgtagctttaatgcatacaaacatgtccctccgcacaactaacctgccctgcctctccatctcgcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattacaaaa

SEQ ID NO: 454417 - DNA, 3841 bp, Homo sapiens
  misc_feature (28)..(28): n is a, c, g, or t
ttcgggcgtttttttatccaggcgtagngaaggaatgaccgggatggcagcggttggaggcttcgcccggctttgcagcggggacttcggcggcggcgcctcaggcacctcggcccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtaccctttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcgcagacctctgctgtagctttaatgcatacaaacatgtccctccgcacaactaacctgccctgcctctccatctcgcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattacaaaa

SEQ ID NO: 454418 - DNA, 4130 bp, Homo sapiens
gctgcgccgaaatgactgaggatgaggtcagacgtggagggtgggaatgcagaaaccgagctctcccgcctgtccccaccggcgcacgctccccagctctccgtctctcaaatgatttgaatgtgttgggggaagtggcaggctgcggtgagagctgagaagaaaggggcttcctcttggagggaggcgctggccctggcatccttttttgggagtgttcaaaggattttgaacgctggaaaaggaatcgtaggctttactgcatcacgatttagaaacacatcctatatttggccgtaatgtaggctgcccttgttttgtggtgtctaaagtgcttgctctacatgttgcaaacgtgggattcagagtgcgaagcaaattgcaagttgttcatttcccccggcatgacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtaccctttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcgcagacctctgctgtagctttaatgcatacaaacatgtccctccgcacaactaacctgccctgcctctccatctcgcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattacaaaa

SEQ ID NO: 454419 - DNA, 3420 bp, Homo sapiens
gccttaaaaagcagaaagctcacactcactcaagtctctctctctctctctgcatatacatatgtgtattctcactgtatctgtagttttctgagtgtgttacataggtgtttctaatcttctaatctctgatggttttgcctgttttaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtaccctttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcgcagacctctgctgtagctttaatgcatacaaacatgtccctccgcacaactaacctgccctgcctctccatctcgcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattacaaaa

SEQ ID NO: 454420 - DNA, 2578 bp, Homo sapiens
ccgcgcggcgcgggggcggggcctacgcgcggtggcgggggcggtggcggctgcccgcgcccctcccccgcacggcgctcagtgccaggctggaggcggcagcggttggaggcttcgcccggctttgcagcggggacttcggcggcggcgcctcaggcacctcggcccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtaccctttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaaataaaaaaaaaaaaaacccaaattttttttattggggccagggtgggaaggagtgggtaacaaagggggagccagggggcctgtgaatggtgaggggaggggttccgctcaacaagatgcaagcacagggtggcgccggggaccc

SEQ ID NO: 454421 - DNA, 2501 bp, Homo sapiens
gcggataatggcggtcccggaatgcaggggcagcaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtaccctttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcgcagacctctgctgtagctttaatgcatacaaacatgtccctccgcacaactaacctgccctgcctctccatctcgcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattacaaaa

SEQ ID NO: 454422 - DNA, 2750 bp, Homo sapiens
acgtaggacactgttgaaggagcctgttttgtcctatagtctaactgtgacccaggagaccctttgtttgagtaaatgcacaggcttcgggatcagaagtggcactgtgacactgtgacacactgttgttttgccacgggatctcagatagatcggccagtgctcattgcattcaaagccccagacatagtagggctttgacttctcttttcaacttggtgactatggcttgccgtttgcaaaatagaaatctacattttatatcttacaagttttgaacagtgttgaactttgtttactgcattttaatcactgcctcctttttttgttttcttagcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtaccctttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcgcagacctctgctgtagctttaatgcatacaaacatgtccctccgcacaactaacctgccctgcctctccatctcgcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattacaaaa

SEQ ID NO: 454423 - DNA, 1653 bp, Homo sapiens
gcggccgcctactactactactgctcgaattcaagcttctaacgatgtacggggcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcgcagacctctgctgtagctttaatgcatacaaacatgtccctccgcacaactaacctgccctgcctctccatctcgcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattacaaaa

SEQ ID NO: 454424 - DNA, 1659 bp, Homo sapiens
ccgcgcggcgcgggggcggggcctacgcgcggtggcgggggcggtggcggctgcccgcgcccctcccccgcacggcgctcagtgccaggctggaggcggcagcggttggaggcttcgcccggctttgcagcggggacttcggcggcggcgcctcaggcacctcggcccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcaacacgacgatccaacacccactgtgctagatgaaagcagacaaggaaagtgtggaggagatctta

SEQ ID NO: 454425 - DNA, 1013 bp, Homo sapiens
gcctaacgatggtcctcagcttgtgagcgcagacctctgctgtagctttaatgcatacaaacatgtccctccgcacaactaacctgccctgcctctccatctcgcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattacaaaa

SEQ ID NO: 454426 - DNA, 931 bp, Homo sapiens
aacgatggtcctacagctatcctgctcagtatactttgtcctgctatgtagaaagccttccacttgtggaaacagtaataatgtggaacagtgagagaaaatgataaaagaatcatgaaaaataacatctacatgagaaggacctttatagtcaagcttcacaagaagactgggaatcaagttgaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattacaaaa

SEQ ID NO: 454427 - DNA, 527 bp, Homo sapiens
agctcggtaccccgagtgggtccctgcgagtgggtccctgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattacaaaa

SEQ ID NO: 454428 - DNA, 1111 bp, Homo sapiens
ccgcgcggcgcgggggcggggcctacgcgcggtggcgggggcggtggcggctgcccgcgcccctcccccgcacggcgctcagtgccaggctggaggcggcagcggttggaggcttcgcccggctttgcagcggggacttcggcggcggcgcctcaggcacctcggcccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgaaaaggagaaaagcccttgaaggcgcaagaccatgacaaccattttcctgtgccgatggacaatgttcttcaacaacagggttacagaccgtattagaccagaacaggtcacctggggcatcttctggcattcccgaacaaaagtaatgcaggaaaccaagtggtccacacttccagatgtgaccctaaccaatggcgcgtcttgtactcgacatcctaataaccattcgacaagaaataactagatatctagcaccacgttcgaggcaaatacgaacattgagaaaatcgcgatatccggaata

SEQ ID NO: 454429 - DNA, 1348 bp, Homo sapiens
gctgcgccgaaatgactgaggatgaggtcagacgtggagggtgggaatgcagaaaccgagctctcccgcctgtccccaccggcgcacgctccccagctctccgtctctcaaatgatttgaatgtgttgggggaagtggcaggctgcggtgagagctgagaagaaaggggcttcctcttggagggaggcgctggccctggcatccttttttgggagtgttcaaaggattttgaacgctggaaaaggaatcgtaggctttactgcatcacgatttagaaacacatcctatatttggccgtaatgtaggctgcccttgttttgtggtgtctaaagtgcttgctctacatgttgcaaacgtgggattcagagtgcgaagcaaattgcaagttgttcatttcccccggcatgacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgaaaaggagaaaagcccttgaaggcgcaagaccatgacaaccattttcctgtgccgatggacaatgttcttcaacaacagggttacagaccgtattagaccagaacaggtcacctggggcatcttctggcattcccgaacaaaagtaatgcaggaaaccaagtggtccacacttccagatgtgaccctaaccaatggcgcgtcttgtactcgacatcctaataaccattcgacaagaaataactagatatctagcaccacgttcgaggcaaatacgaacattgagaaaatcgcgatatccggaata

SEQ ID NO: 454430 - DNA, 4146 bp, Homo sapiens
  misc_feature (4120)..(4120): n is a, c, g, or t
ccgcgcggcgcgggggcggggcctacgcgcggtggcgggggcggtggcggctgcccgcgcccctcccccgcacggcgctcagtgccaggctggaggcggcagcggttggaggcttcgcccggctttgcagcggggacttcggcggcggcgcctcaggcacctcggcccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtaccctttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcgcagacctctgctgtagctttaatgcatacaaacatgtccctccgcacaactaacctgccctgcctctccatctcgcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattacaaaaaaaaccagacataccaacgacaaaagcggcggggcggtaaaaaatccccgaggaggccgacgtttccggcatccccagttttggggacaaaagggcccaataggggagagtaattaaaaaaggaggggccagtaaaacaccgcgggaggaaacgccgcggcactcgtgaggaccctctgcggcggcacagggcccatccagagtagccgggcaatactagttagggnacaccattcggatgttgcctgatacg

SEQ ID NO: 454431 - DNA, 4160 bp, Homo sapiens
  misc_feature (3271)..(3271): n is a, c, g, or t
  misc_feature (3273)..(3273): n is a, c, g, or t
  misc_feature (3284)..(3284): n is a, c, g, or t
  misc_feature (3286)..(3286): n is a, c, g, or t
  misc_feature (3290)..(3291): n is a, c, g, or t
  misc_feature (3300)..(3301): n is a, c, g, or t
  misc_feature (3325)..(3325): n is a, c, g, or t
  misc_feature (3357)..(3357): n is a, c, g, or t
  misc_feature (3456)..(3456): n is a, c, g, or t
  misc_feature (3461)..(3461): n is a, c, g, or t
  misc_feature (3490)..(3490): n is a, c, g, or t
  misc_feature (3509)..(3509): n is a, c, g, or t
  misc_feature (3579)..(3579): n is a, c, g, or t
  misc_feature (3582)..(3583): n is a, c, g, or t
  misc_feature (3587)..(3587): n is a, c, g, or t
  misc_feature (3606)..(3606): n is a, c, g, or t
  misc_feature (3623)..(3623): n is a, c, g, or t
  misc_feature (3635)..(3638): n is a, c, g, or t
  misc_feature (3643)..(3643): n is a, c, g, or t
  misc_feature (3700)..(3700): n is a, c, g, or t
  misc_feature (3725)..(3725): n is a, c, g, or t
  misc_feature (3729)..(3729): n is a, c, g, or t
  misc_feature (3735)..(3735): n is a, c, g, or t
  misc_feature (3737)..(3737): n is a, c, g, or t
  misc_feature (3743)..(3743): n is a, c, g, or t
  misc_feature (3762)..(3767): n is a, c, g, or t
  misc_feature (4134)..(4134): n is a, c, g, or t
ccgcgcggcgcgggggcggggcctacgcgcggtggcgggggcggtggcggctgcccgcgcccctcccccgcacggcgctcagtgccaggctggaggcggcagcggttggaggcttcgcccggctttgcagcggggacttcggcggcggcgcctcaggcacctcggcccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtaccctttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcgcagacctctgctgtagctttaatgcatacaaacatgtccctccgcacaactaacctgccctgcctctccatctcgcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggaccccccccccacccctccccccccgcccccccngncgccgcgcccncncccnncccccgccnncccccccccccccccccccccccncccccccccccccccccccccccccccccccnccccccgcccccccccccccccccccccccacccgccccccccccccccccccgccgcccccccccccccccccccccccccccccccccccccccccnagccnccccccccccccccccccccccacccccnccccccccccccccccccncacacccccccccccccccccccccccgcccccccccccccccccccccccccccccccccccccccccnccnncccnccccccccccccccccccncccccccccccccccgncgccccccacgnnnnccccncccccccccccccccccccccgcccccccccccccgccccccgcccctcccccccgnacccccccccccccaccgccccgcncccncccccnangccccncgcgccccccccccccccnnnnnnctttttttttttttttttaagccatgacatcccagaagaggacagtgaattactcctaggtcggctcttatagagtggccatagtgttctgtcaaaacacttgcttccattttcagagataaaaatcattgattacaaaaaaaaccagacataccaacgacaaaagcggcggggcggtaaaaaatccccgaggaggccgacgtttccggcatccccagttttggggacaaaagggcccaataggggagagtaattaaaaaaggaggggccagtaaaacaccgcgggaggaaacgccgcggcactcgtgaggaccctctgcggcggcacagggcccatccagagtagccgggcaatactagttagggnacaccattcggatgttgcctgatacg

SEQ ID NO: 454432 - DNA, 3516 bp, Homo sapiens
tcgactctagcaggatcctctggccgcgtggattcctaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtaccctttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcgcagacctctgctgtagctttaatgcatacaaacatgtccctccgcacaactaacctgccctgcctctccatctcgcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattacaaaa

SEQ ID NO: 454433 - DNA, 3878 bp, Homo sapiens
ccgcgcggcgcgggggcggggcctacgcgcggtggcgggggcggtggcggctgcccgcgcccctcccccgcacggcgctcagtgccaggctggaggcggcagcggttggaggcttcgcccggctttgcagcggggacttcggcggcggcgcctcaggcacctcggcccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcaattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtaccctttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcgcagacctctgctgtagctttaatgcatacaaacatgtccctccgcacaactaacctgccctgcctctccatctcgcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattacaaaa

SEQ ID NO: 454434 - DNA, 1751 bp, Homo sapiens
  misc_feature (1741)..(1741): n is a, c, g, or t
ccgcgcggcgcgggggcggggcctacgcgcggtggcgggggcggtggcggctgcccgcgcccctcccccgcacggcgctcagtgccaggctggaggcggcagcggttggaggcttcgcccggctttgcagcggggacttcggcggcggcgcctcaggcacctcggcccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagattgcctaatgaaggtnccgagctcga

SEQ ID NO: 454435 - DNA, 4004 bp, Homo sapiens
ccgcgcggcgcgggggcggggcctacgcgcggtggcgggggcggtggcggctgcccgcgcccctcccccgcacggcgctcagtgccaggctggaggcggcagcggttggaggcttcgcccggctttgcagcggggacttcggcggcggcgcctcaggcacctcggcccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccaggtaaagaatcgagattgtcaagtattctaggttggtgtaactgtgtgacaattatttgtacttggactagcatatacttcagatctcaaaaatatctgaccattctgagcaagaaagtagtagaattgtacacattgccatgagatggcactttctaaggatatcactaaaactgagtttcttcattagaaaaaaatctcaaaaaaaaaaaaaaaagaaaagaaaaaaatctcacttttttttttttgagacggagtctggctctgttgcccaggcaggagtgcagtggtgtgatctcagctcactgcaacctccgcctccctggttcaagcaattctcctgccttagccttccaagtagctgggattacaggcgcccaccaccacacccggcacatctcactttttatcatcacctgaatgcctggtgataccagagcaatacagctacaagaaattctatgaagcccaagtctttctatccttgtgtgtactgtggaattaatacctcatttcctgcccatataactgaagtgcaacaatgaagcagcatagctggggtgtattgcacacctactgaaatagtgaaacatgcatctttaatcttcaagctgaggccatggtcagcgttccctggtgggcaagtagggagagcctggctcggggatggaaaagtgggtggttttcctaccctatgagtggaagaaccagagtcaaaactgtatttggggccccactggtcctaaaatagagaaaccaaaggtcctataatggggcggtaggttagcttgatttaggaagttcagctatgatataatttctacctctctgtactacttctgatttttagaaaattcatattctaaatgctagcaggcttcctaagggacaggcttttttctcatgctagtcaacaaatatatcctctgagactcagtgaccactggccatttcaaacaacagaataattagcactacatcatcacatataaggtcgtaccaaacatttgtgtaacactgtgtttatgtggacttttaaaacgcttgctgttctggtctcacaattaaagaattgatacttacgtcttccaaataaaaggaagagaatttttataagccccttttttatattaatctctactaaaaataaaaaatttgctatgtgtggtcgtgggtgcctgtaatcccagctaattgggaggcagagtcaggagaatcgcttgaacccaggaggcggagtgagccgagatggtgccactgcactccagcctgggcaacacagcgagactccgtctcaaacaaacaaaaacaaacaaaccaaaactctctatgtgattttttttttttagttggaataatgaaggaaagctgttaaagataattgaaaattgtggtttaaaccaaactaatcaaaattggttcaaaatagactgaattcaaatttatgattacatccaatattttgaaacacatttgttgtcatctaaaagttcgacagactataaacacagttgttcagaatgtctccgatttatgaagtgtttcttgagcatttattgtatgccaggactgtgctaaatatgctacttgctacctctttcttttcataacaatcatatgtggtaggtgtaacttttatccccattttatggatgaagaacttaaggcttggtgaggttgtcacactctcgtgggttttggtagtagagctggaagtcaaagccaagtcagtctttttattggctatactaaccacagaattttcattaaatcagtctttaaaaatgtttttgggccaggagtggtggttcaccctgtaatcccaacactttgggaggccaaggtgggaggatcacttgagcctgggagttcaagagcagtatggacaatctagtgagaccctgtctctacaaaacattaaaaaaattagccaggtgtggtagtacgtacctgtggtcccagttattccagaggctgaggatttggcttgagcccaggaggtcaagacctcaatgagcttgtgccactgcactccagcctgggcgatggagcaagacccagtcccaaaaaaaaaaaaaaaaaaaaaaaaaaggtttttggtttatctgggactcttttagtttttggttgaaatagtaaagaggcacatttgacacaaccttccttttaaagaggatgatgattttataaacctttaccaccctgagctctactcagcttttgttcccctgatgcgttagagcagtgtatctgccaggttgtcttcaatggactcctgcccagtttcagatgccaaaggctgcaggtttccaggagaaatggttttgcatatttgatgtggctgtgtcttctctgacttaaactcttggaattcagaaaacatttccccagcagcattgacgcccacattcaactccccccttgcacaccagccgtttgatctggtgatctggccaggatgctcactaaggctacctctcttgccaggagctttagagactttttttgttgtttcccgtcttgactgaaaaagaaaattggcttgaccttatcagggtcatcataagagaagtcatttctggtctgtttagttctcttgtaggatacaaataaaaatgttatacctttcttccccattacagagctctttgctcccttcttccagtattacagtgcaagtggctttacattctctttccacattttggatagtttcacatttttcttgagtgtcatgtacgatgtggtttgctaggatgagaaaatcataatcctaggattgttttcttttgctttctaaaagtcatatttatacttatatgttcaacc

SEQ ID NO: 454436 - DNA, 1210 bp, Homo sapiens
tcaaatattttccaccccaggttggttgaatccatggatgcaaaacccatggatacagggggaaaacctaactatgttttttcctttacagtagcaagcatgtggcatatacagcatgtatatgctagacgaagggatgattcatgtcccaggaggaacagagtgggaaggaatcacactacttggaatggcatacaatttaaaacttaacaaattttttatttctgaaattttccatttaatattctcagaccatggttgacagcaggaaactgaaactgcagtaagcaaaaccacaaataagaaggaactacgataatattttagctttccaaatgccattttttacccacaagtacaaggtatgtactttatggttttagcaaaagtaacgagttcttgccaaactattcacatatttaaaatgatctggtgactttgcatttacaagaggttggttgggattatctctaggatcaatggcaatgaacaagagggaaataacagagcatataattccatgaccttggaaatatggcctctgtgaacacttctatccctgaagtaattattgaggaagaaaatatttttgtccttgcttttaatgaaatctgtagaattaatatactcaaccaagcaaatgatcctggacactgctttcactttgagtggcttctttattcttgatcaggttttatataacttgtctctggtacttaccataataccatatgttgataataacctttgcattgaaaagtcctgataaatgtatttttaaaatatgtgctgctataatgcatatttatattaaagctgaatcaataaacacaatattttattgtgggaaggattttcaaccatgctgcttagcttaacagagcactcataaataccaaaagttccttagtaagcccaaactcactctaccaaatctaaaagcacactgttttgagatggaatagtatcccttagacttctatttgttaaaacaataactaaatttgagttaaataattacacatagtgcttacaatgtataaaatacttccacaaaaaagttgttattggttaaattgtgtccccaaaaagatatgttttaaatactaaccccggaaaactgtgaacataaccttatttgaaaatagggtctttttagatatagtcaaatttggaggcagatcaaatttagatataatcaaatttggat

SEQ ID NO: 454437 - DNA, 517 bp, Homo sapiens
  misc_feature (37)..(37): n is a, c, g, or t
gcaattggtccccaggacacagggttgatgggcctcntggtccacaggacttcaggacctaaggggaatatgggcttaaatttccagggacccaaaggtgaaaaaggtgagcaaggtcttcagggcccacctgggccacctgggcagatcagtgaacagaaaagaccaattgatgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaa

SEQ ID NO: 454438 - DNA, 730 bp, Homo sapiens
aacaagagcaaaactccatcacaataaattaaataaataaataaataaataaacctcataaccagcagtttaacttgtttctatatatatagtaagcttagagaatagtacaagtagatagccatgttcaatgtgccacagaactgaaagatttaacataaatgaacaatcttattttgtacataacacacagcccaggatatttaggtaggaagtgatattttataatgttatctagactataacctttctgacttacactaaaatgtaagctgcataaagtcagagatttttgtgtatttttgttttctgatgtatcaccagcacttgacacatagtaggagcccaaaaatatttgttggaggaatgagtaagtggaatgatcacacataccatctcataataccactcacttatatagcttttaagaagaactatttatggctatatcctttccccagttgtattcagtaccaacctacagatagttgttgtatctatatgtttctgtattaaacttttccctttttagggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtgtttactgtgtttgttttcttgtgctt

SEQ ID NO: 454439 - DNA, 674 bp, Homo sapiens
gagccctgatcaggtgatttccaaaaccaaagccagaagtctgccagatgtttctttcaaatggccaatgggcagggggtgtgttcaagccacagtttatcttcgcagtggtttgacttgattgtacaaagggagatcctgtgacacttttacaacatctttccaagaacacaaggtatgtgacatttcccttacccaaccacggccagttggttgtgttttaactttgcgcacctcagttagccatgggaagttcattttgtctgtcagccaggggtatattttaacaatatgaactgtctcatttaattctcaccacaaccctatgaagtaaatactgttattttctccaaatttgaggtgagaaaactatgaatcaaggaggttaaataatcaactcaattcacacaagataatataaggcaaaattgagattacagtcttggaagtttgactctagaaatagtgctatatgccactatgtaattcttatgccctcaatcaccttcctcccctcgctgcaatttttttgtaacattaatgattttatttattcagggtaatcctggccggccgggtctcaatggaatgaaaggagatcctggtctccctggtgttccaggattcccaggtatttgaagggatttttgtggtttccctttatattaaactcc

SEQ ID NO: 454440 - DNA, 6467 bp, Homo sapiens
aggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggcttgctatgggtgttctccaggatcaaagtgtgactgcagtggcataaaaggggaaaagggagagagagggtttccaggtttggaaggacacccaggattgcctggatttccaggtccagaagggcctccggggcctcggggacaaaagggtgatgatggaattccagggccaccaggaccaaaaggaatcagaggtcctcctggacttcctggatttccagggacaccaggtcttcctggaatgccaggccacgatggggccccaggacctcaaggtattcccggatgcaatggaaccaagggagaacgtggatttccaggcagtcccggttttcctggtttacagggtcctccaggaccccctgggatcccaggtatgaagggtgaaccaggtagtataattatgtcatcactgccaggaccaaagggtaatccaggatatccaggtcctcctggaatacaaggcctacctggtcccactggtataccagggccaattggtcccccaggaccaccaggtttgatgggccctcctggtccaccaggacttccaggacctaaggggaatatgggcttaaatttccagggacccaaaggtgaaaaaggtgagcaaggtcttcagggcccacctgggccacctgggcagatcagtgaacagaaaagaccaattgatgtagagtttcagaaaggagatcagggacttcctggtgaccgagggcctcctggacctccagggatacgtggtcctccaggtcccccaggtggtgagaaaggtgagaagggtgagcaaggagagccaggcaaaagaggtaaaccaggcaaagatggagaaaatggccaaccaggaattcctggtttgcctggtgatcctggttaccctggtgaacccggaagggatggtgaaaagggccaaaaaggtgacactggcccacctggacctcctggacttgtaattcctagacctgggactggtataactataggagaaaaaggaaacattgggttgcctgggttgcctggagaaaaaggagagcgaggatttcctggaatacagggtccacctggccttcctggacctccaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtgatgagatatgtgaaccaggccctccaggccccccaggatctccaggtgataaaggactccaaggagaacaaggagtgaaaggtgacaaaggtgacacttgcttcaactgcattggaactggtatttcagggcctccaggtcaacctggtttgccaggtctcccaggtcctccaggatctcttggtttccctggacagaaaggggaaaaaggacaagctggtgcaactggtcccaaaggattaccaggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagggtgagcctggtctgcctggatacccagggaaccctggtatcaaaggttctgtgggagatcctggtttgcccggattaccaggaacccctggagcaaaaggacaaccaggccttcctggattcccaggaaccccaggccctcctggaccaaaaggtattagtggccctcctgggaaccccggccttccaggagaacctggtcctgtaggtggtggaggtcatcctgggcaaccagggcctccaggcgaaaaaggcaaacccggtcaagatggtattcctggaccagctggacagaagggtgaaccaggtcaaccaggctttggaaacccaggaccccctggacttccaggactttctggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggttattaaggtctaccaggtccagaaggtcctccaggtctccctggaaatggaggtattaaaggagagaagggaaatccaggccaacctgggctacctggcttgcctggtttgaaaggagatcaaggaccaccaggactccagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaaacccgccaaacgaaaagctctataactttgaattc

SEQ ID NO: 454441 - DNA, 6432 bp, Homo sapiens
aggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggcttgctatgggtgttctccaggatcaaagtgtgactgcagtggcataaaaggggaaaagggagagagagggtttccaggtttggaaggacacccaggattgcctggatttccaggtccagaagggcctccggggcctcggggacaaaagggtgatgatggaattccagggccaccaggaccaaaaggaatcagaggtcctcctggacttcctggatttccagggacaccaggtcttcctggaatgccaggccacgatggggccccaggacctcaaggtattcccggatgcaatggaaccaagggagaacgtggatttccaggcagtcccggttttcctggtttacagggtcctccaggaccccctgggatcccaggtatgaagggtgaaccaggtagtataattatgtcatcactgccaggaccaaagggtaatccaggatatccaggtcctcctggaatacaaggcctacctggtcccactggtataccagggccaattggtcccccaggaccaccaggtttgatgggccctcctggtccaccaggacttccaggacctaaggggaatatgggcttaaatttccagggacccaaaggtgaaaaaggtgagcaaggtcttcagggcccacctgggccacctgggcagatcagtgaacagaaaagaccaattgatgtagagtttcagaaaggagatcagggacttcctggtgaccgagggcctcctggacctccagggatacgtggtcctccaggtcccccaggtggtgagaaaggtgagaagggtgagcaaggagagccaggcaaaagaggtaaaccaggcaaagatggagaaaatggccaaccaggaattcctggtttgcctggtgatcctggttaccctggtgaacccggaagggatggtgaaaagggccaaaaaggtgacactggcccacctggacctcctggacttgtaattcctagacctgggactggtataactataggagaaaaaggaaacattgggttgcctgggttgcctggagaaaaaggagagcgaggatttcctggaatacagggtccacctggccttcctggacctccaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtgatgagatatgtgaaccaggccctccaggccccccaggatctccaggtgataaaggactccaaggagaacaaggagtgaaaggtgacaaaggtgacacttgcttcaactgcattggaactggtatttcagggcctccaggtcaacctggtttgccaggtctcccaggtcctccaggatctcttggtttccctggacagaaaggggaaaaaggacaagctggtgcaactggtcccaaaggattaccaggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagggtgagcctggtctgcctggatacccagggaaccctggtatcaaaggttctgtgggagatcctggtttgcccggattaccaggaacccctggagcaaaaggacaaccaggccttcctggattcccaggaaccccaggccctcctggaccaaaaggtattagtggccctcctgggaaccccggccttccaggagaacctggtcctgtaggtggtggaggtcatcctgggcaaccagggcctccaggcgaaaaaggcaaacccggtcaagatggtattcctggaccagctggacagaagggtgaaccaggtcaaccaggctttggaaacccaggaccccctggacttccaggactttctggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggttattaaggtctaccaggtccagaaggtcctccaggtctccctggaaatggaggtattaaaggagagaagggaaatccaggccaacctgggctacctggcttgcctggtttgaaaggagatcaaggaccaccaggactccagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaa

SEQ ID NO: 454442 - DNA, 5018 bp, Homo sapiens
aacaagagcaaaactccatcacaataaattaaataaataaataaataaataaacctcataaccagcagtttaacttgtttctatatatatagtaagcttagagaatagtacaagtagatagccatgttcaatgtgccacagaactgaaagatttaacataaatgaacaatcttattttgtacataacacacagcccaggatatttaggtaggaagtgatattttataatgttatctagactataacctttctgacttacactaaaatgtaagctgcataaagtcagagatttttgtgtatttttgttttctgatgtatcaccagcacttgacacatagtaggagcccaaaaatatttgttggaggaatgagtaagtggaatgatcacacataccatctcataataccactcacttatatagcttttaagaagaactatttatggctatatcctttccccagttgtattcagtaccaacctacagatagttgttgtatctatatgtttctgtattaaacttttccctttttagggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagggtgagcctggtctgcctggatacccagggaaccctggtatcaaaggttctgtgggagatcctggtttgcccggattaccaggaacccctggagcaaaaggacaaccaggccttcctggattcccaggaaccccaggccctcctggaccaaaaggtattagtggccctcctgggaaccccggccttccaggagaacctggtcctgtaggtggtggaggtcatcctgggcaaccagggcctccaggcgaaaaaggcaaacccggtcaagatggtattcctggaccagctggacagaagggtgaaccaggtcaaccaggctttggaaacccaggaccccctggacttccaggactttctggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggttattaaggtctaccaggtccagaaggtcctccaggtctccctggaaatggaggtattaaaggagagaagggaaatccaggccaacctgggctacctggcttgcctggtttgaaaggagatcaaggaccaccaggactccagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaaacccgccaaacgaaaagctctataactttgaattc

SEQ ID NO: 454443 - DNA, 6378 bp, Homo sapiens
aggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggcttgctatgggtgttctccaggatcaaagtgtgactgcagtggcataaaaggggaaaagggagagagagggtttccaggtttggaaggacacccaggattgcctggatttccaggtccagaagggcctccggggcctcggggacaaaagggtgatgatggaattccagggccaccaggaccaaaaggaatcagaggtcctcctggacttcctggatttccagggacaccaggtcttcctggaatgccaggccacgatggggccccaggacctcaaggtattcccggatgcaatggaaccaagggagaacgtggatttccaggcagtcccggttttcctggtttacagggtcctccaggaccccctgggatcccaggtatgaagggtgaaccaggtagtataattatgtcatcactgccaggaccaaagggtaatccaggatatccaggtcctcctggaatacaaggcctacctggtcccactggtataccagggccaattggtcccccaggaccaccaggtttgatgggccctcctggtccaccaggacttccaggacctaaggggaatatgggcttaaatttccagggacccaaaggtgaaaaaggtgagcaaggtcttcagggcccacctgggccacctgggcagatcagtgaacagaaaagaccaattgatgtagagtttcagaaaggagatcagggacttcctggtgaccgagggcctcctggacctccagggatacgtggtcctccaggtcccccaggtggtgagaaaggtgagaagggtgagcaaggagagccaggcaaaagaggtaaaccaggcaaagatggagaaaatggccaaccaggaattcctggtttgcctggtgatcctggttaccctggtgaacccggaagggatggtgaaaagggccaaaaaggtgacactggcccacctggacctcctggacttgtaattcctagacctgggactggtataactataggagaaaaaggaaacattgggttgcctgggttgcctggagaaaaaggagagcgaggatttcctggaatacagggtccacctggccttcctggacctccaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtgatgagatatgtgaaccaggccctccaggccccccaggatctccaggtgataaaggactccaaggagaacaaggagtgaaaggtgacaaaggtgacacttgcttcaactgcattggaactggtatttcagggcctccaggtcaacctggtttgccaggtctcccaggtcctccaggatctcttggtttccctggacagaaaggggaaaaaggacaagctggtgcaactggtcccaaaggattaccaggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagggtgagcctggtctgcctggatacccagggaaccctggtatcaaaggttctgtgggagatcctggtttgcccggattaccaggaacccctggagcaaaaggacaaccaggccttcctggattcccaggaaccccaggccctcctggaccaaaaggtattagtggccctcctgggaaccccggccttccaggagaacctggtcctgtaggtggtggaggtcatcctgggcaaccagggcctccaggcgaaaaaggcaaacccggtcaagatggtattcctggaccagctggacagaagggtgaaccaggtcaaccaggctttggaaacccaggaccccctggacttccaggactttctggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggttattaaggtctaccaggtccagaaggtcctccaggtctccctggaaatggaggtattaaaggagagaagggaaatccaggccaacctgggctacctggcttgcctggtttgaaaggagatcaaggaccaccaggactccagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataataccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaa

SEQ ID NO: 454444 - DNA, 2330 bp, Homo sapiens
gaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgtcttaaaaaaaaaaaaaaaaaaaaaaaaaaaaaaaaaaaaaaaaaaaaaaaaaaaaaaaaaaaaaaaaaaaaaaaaaaaaaaaaaaaaaaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaa

SEQ ID NO: 454445 - DNA, 5340 bp, Homo sapiens
aggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggcttgctatgggtgttctccaggatcaaagtgtgactgcagtggcataaaaggggaaaagggagagagagggtttccaggtttggaaggacacccaggattgcctggatttccaggtccagaagggcctccggggcctcggggacaaaagggtgatgatggaattccagggccaccaggaccaaaaggaatcagaggtcctcctggacttcctggatttccagggacaccaggtcttcctggaatgccaggccacgatggggccccaggacctcaaggtattcccggatgcaatggaaccaagggagaacgtggatttccaggcagtcccggttttcctggtttacagggtcctccaggaccccctgggatcccaggtatgaagggtgaaccaggtagtataattatgtcatcactgccaggaccaaagggtaatccaggatatccaggtcctcctggaatacaaggcctacctggtcccactggtataccagggccaattggtcccccaggaccaccaggtttgatgggccctcctggtccaccaggacttccaggacctaaggggaatatgggcttaaatttccagggacccaaaggtgaaaaaggtgagcaaggtcttcagggcccacctgggccacctgggcagatcagtgaacagaaaagaccaattgatgtagagtttcagaaaggagatcagggacttcctggtgaccgagggcctcctggacctccagggatacgtggtcctccaggtcccccaggtggtgagaaaggtgagaagggtgagcaaggagagccaggcaaaagaggtaaaccaggcaaagatggagaaaatggccaaccaggaattcctggtttgcctggtgatcctggttaccctggtgaacccggaagggatggtgaaaagggccaaaaaggtgacactggcccacctggacctcctggacttgtaattcctagacctgggactggtataactataggagaaaaaggaaacattgggttgcctgggttgcctggagaaaaaggagagcgaggatttcctggaatacagggtccacctggccttcctggacctccaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtgatgagatatgtgaaccaggccctccaggccccccaggatctccaggtgataaaggactccaaggagaacaaggagtgaaaggtgacaaaggtgacacttgcttcaactgcattggaactggtatttcagggcctccaggtcaacctggtttgccaggtctcccaggtcctccaggatctcttggtttccctggacagaaaggggaaaaaggacaagctggtgcaactggtcccaaaggattaccaggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagggtgagcctggtctgcctggatacccagggaaccctggtatcaaaggttctgtgggagatcctggtttgcccggattaccaggaacccctggagcaaaaggacaaccaggccttcctggattcccaggaaccccaggccctcctggaccaaaaggtattagtggccctcctgggaaccccggccttccaggagaacctggtcctgtaggtggtggaggtcatcctgggcaaccagggcctccaggcgaaaaaggcaaacccggtcaagatggtattcctggaccagctggacagaagggtgaaccaggtcaaccaggctttggaaacccaggaccccctggacttccaggactttctggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggttattaaggtctaccaggtccagaaggtcctccaggtctccctggaaatggaggtattaaaggagagaagggaaatccaggccaacctgggctacctggcttgcctggtttgaaaggagatcaaggaccaccaggactccagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatggtattttacactcttccttgcatttgtcatcatagctgactgtccattccatctacatttcttcccaatatgaggaatccctgtcatttgcataataagaagcttaaacttcaaacagcttctatccaagcactgtgttccccctcacacattttttgtaacatattttcataatctgcctattacttttttttgactacccttggtgtggatactattgtcttacctctgggcctgttccttcactagatttgaatttggccaagctcagcacacatctttggatattcactaagctattatggcacatgggtattgcggcacat

SEQ ID NO: 454446 - DNA, 235 bp, Homo sapiens
gggccacccggctttccaggaccaaaggtctgggacatttttctttattccttctcattttcttatctttcccaccttccttatttctagctctctattttgactcagatatcatcccaagccccaagtctttactataaatatacagataacttattatatttccattaaaaaaatatttaaccccaaatcatctttaatagtccaaggtcacatttggagcaaaaaaaaaaaa

SEQ ID NO: 454447 - DNA, 318 bp, Homo sapiens
gtcataatgttttgtcaatatccataagagtggatcagagcttacttaatcttgtatactgattatttcgtggaaataggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttgggtgagataatcaatatctaatttcct

SEQ ID NO: 454448 - DNA, 793 bp, Homo sapiens
taaacttcaaacagcttctatccaagcactgtgttccccctcacacattttttgtaacatattttcataatctgcctattacttttttttgactacccttggtgtggatactattgtcttacctctgggcctgttccttcactagatttgaatttggccaagctcagcacacatctttggatattcactaagctattatggcacatgggtattgcggcacatttttccttgtcttttatagcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcaggtaaagtgcttatagctttaattcaggtccaaagcttccttcagagatgctagggaagaaagagacaatttatggatggtttatcctcaacaaatgttaggaatttattggattgtgtactttattcttgcttgttcttctcatatacatgactcaggtcagaaaaacagacttgattattaatattaggtgagtttggtttgtgatagcttagtagtaatccttcaataatgaaacagagataaagaaaggttatgtgaccttcctaataagtcagcagctgttcaactagattgagaccaccccaggaattgaagttacagtctgtcttttccctctcagtccagtggtctcctttcccaggatattttaaagattc

SEQ ID NO: 454449 - DNA, 689 bp, Homo sapiens
  misc_feature (474)..(474): n is a, c, g, or t
  misc_feature (564)..(564): n is a, c, g, or t
  misc_feature (613)..(613): n is a, c, g, or t
aggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggcttgctatgggtgctctccaggatcaaagtgtgactgcccccgctaaccggctttttgcccaaatgggccattatcgaagaattcacataaaacaatagcctcatcatccccaccatcatagccaccatcaccctccttaacctctacttctacctacgcctaatctactccacctcaatcacactactncccatatctaacaacgtaaaaataaaatgacagcttgaacatacaaaacccaccccattccttcccacactcaatcgccttaccacgctnactctacctatctcccttttatactaataatcttataaatactaaaacntcttcaccttcctctcaaaaatggccgcgctttacaaggcggcctggcaaaccctggcgttccaacttaatcgctt

SEQ ID NO: 454450 - DNA, 6259 bp, Homo sapiens
aggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggcttgctatgggtgttctccaggatcaaagtgtgactgcagtggcataaaaggggaaaagggagagagagggtttccaggtttggaaggacacccaggattgcctggatttccaggtccagaagggcctccggggcctcggggacaaaagggtgatgatggaattccagggccaccaggaccaaaaggaatcagaggtcctcctggacttcctggatttccagggacaccaggtcttcctggaatgccaggccacgatggggccccaggacctcaaggtattcccggatgcaatggaaccaagggagaacgtggatttccaggcagtcccggttttcctggtttacagggtcctccaggaccccctgggatcccaggtatgaagggtgaaccaggtagtataattatgtcatcactgccaggaccaaagggtaatccaggatatccaggtcctcctggaatacaaggcctacctggtcccactggtataccagggccaattggtcccccaggaccaccaggtttgatgggccctcctggtccaccaggacttccaggacctaaggggaatatgggcttaaatttccagggacccaaaggtgaaaaaggtgagcaaggtcttcagggcccacctgggccacctgggcagatcagtgaacagaaaagaccaattgatgtagagtttcagaaaggagatcagggacttcctggtgaccgagggcctcctggacctccagggatacgtggtcctccaggtcccccaggtggtgagaaaggtgagaagggtgagcaaggagagccaggcaaaagaggtaaaccaggcaaagatggagaaaatggccaaccaggaattcctggtttgcctggtgatcctggttaccctggtgaacccggaagggatggtgaaaagggccaaaaaggtgacactggcccacctggacctcctggacttgtaattcctagacctgggactggtataactataggagaaaaaggaaacattgggttgcctgggttgcctggagaaaaaggagagcgaggatttcctggaatacagggtccacctggccttcctggacctccaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtgatgagatatgtgaaccaggccctccaggccccccaggatctccaggtgataaaggactccaaggagaacaaggagtgaaaggtgacaaaggtgacacttgcttcaactgcattggaactggtatttcagggcctccaggtcaacctggtttgccaggtctcccaggtcctccaggatctcttggtttccctggacagaaaggggaaaaaggacaagctggtgcaactggtcccaaaggattaccaggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagggtgagcctggtctgcctggatacccagggaaccctggtatcaaaggttctgtgggagatcctggtttgcccggattaccaggaacccctggagcaaaaggacaaccaggccttcctggattcccaggaaccccaggccctcctggaccaaaaggtattagtggccctcctgggaaccccggccttccaggagaacctggtcctgtaggtggtggaggtcatcctgggcaaccagggcctccaggcgaaaaaggcaaacccggtcaagatggtattcctggaccagctggacagaagggtgaaccaggtcaaccaggctttggaaacccaggaccccctggacttccaggactttctggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggttattaaggtctaccaggtccagaaggtcctccaggtctccctggaaatggaggtattaaaggagagaagggaaatccaggccaacctgggctacctggcttgcctggtttgaaaggagatcaaggaccaccaggactccagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaa

SEQ ID NO: 454451 - DNA, 5727 bp, Homo sapiens
accctgttctttcctctccaattgctgctaggctgctggttttcaccttgattgtgaggagaggtggtgtgaatagagcaagttaaaatgccacaaagctctgagaggtggtgggaatagagcaagttaaaatgccataaatctctgagaggtggtaggaatagagcaagttaaaatgccacaaagctctgagttctcaccaagattcagctttttttttttttttttttctgagaaaacactccttgaattgctgcaagctttggttaagttctgaaagttaattctgactgaccatttttgccagtattctcattgcttctatggagaagacaatctttggagatttcctaacaccatcatttgtgctgatgtcaccctatcctctatgttttaaagggtttgcctggtgatcctggttaccctggtgaacccggaagggatggtgaaaaggccaaaagggtgacacgggcccaccgggacctccgggactggtaattcctagacctgggactggtataactataggagaaaaaggaaacattgggttgcctgggttgcctggagaaaaaggagagcgaggatttcctggaatacagggtccacctggccttcctggacctccaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtgatgagatatgtgaaccaggccctccaggccccccaggatctccaggtgataaaggactccaaggagaacaaggagtgaaaggtgacaaaggtgacacttgcttcaactgcattggaactggtatttcagggcctccaggtcaacctggtttgccaggtctcccaggtcctccaggatctcttggtttccctggacagaaaggggaaaaaggacaagctggtgcaactggtcccaaaggattaccaggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagggtgagcctggtctgcctggatacccagggaaccctggtatcaaaggttctgtgggagatcctggtttgcccggattaccaggaacccctggagcaaaaggacaaccaggccttcctggattcccaggaaccccaggccctcctggaccaaaaggtattagtggccctcctgggaaccccggccttccaggagaacctggtcctgtaggtggtggaggtcatcctgggcaaccagggcctccaggcgaaaaaggcaaacccggtcaagatggtattcctggaccagctggacagaagggtgaaccaggtcaaccaggctttggaaacccaggaccccctggacttccaggactttctggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggttattaaggtctaccaggtccagaaggtcctccaggtctccctggaaatggaggtattaaaggagagaagggaaatccaggccaacctgggctacctggcttgcctggtttgaaaggagatcaaggaccaccaggactccagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaaacccgccaaacgaaaagctctataactttgaattc

SEQ ID NO: 454452 - DNA, 2855 bp, Homo sapiens
gagccctgatcaggtgatttccaaaaccaaagccagaagtctgccagatgtttctttcaaatggccaatgggcagggggtgtgttcaagccacagtttatcttcgcagtggtttgacttgattgtacaaagggagatcctgtgacacttttacaacatctttccaagaacacaaggtatgtgacatttcccttacccaaccacggccagttggttgtgttttaactttgcgcacctcagttagccatgggaagttcattttgtctgtcagccaggggtatattttaacaatatgaactgtctcatttaattctcaccacaaccctatgaagtaaatactgttattttctccaaatttgaggtgagaaaactatgaatcaaggaggttaaataatcaactcaattcacacaagataatataaggcaaaattgagattacagtcttggaagtttgactctagaaatagtgctatatgccactatgtaattcttatgccctcaatcaccttcctcccctcgctgcaatttttttgtaacattaatgattttatttattcagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaa

SEQ ID NO: 454453 - DNA, 4232 bp, Homo sapiens
aggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggcttgctatgggtgttctccaggatcaaagtgtgactgcagtggcataaaaggggaaaagggagagagagggtttccaggtttggaaggacacccaggattgcctggatttccaggtccagaagggcctccggggcctcggggacaaaagggtgatgatggaattccagggccaccaggaccaaaaggaatcagaggtcctcctggacttcctggatttccagggacaccaggtcttcctggaatgccaggccacgatggggccccaggacctcaaggtattcccggatgcaatggaaccaagggagaacgtggatttccaggcagtcccggttttcctggtttacagggtcctccaggaccccctgggatcccaggtatgaagggtgaaccaggtagtataattatgtcatcactgccaggaccaaagggtaatccaggatatccaggtcctcctggaatacaaggcctacctggtcccactggtataccagggccaattggtcccccaggaccaccaggtttgatgggccctcctggtccaccaggacttccaggacctaaggggaatatgggcttaaatttccagggacccaaaggtgaaaaaggtgagcaaggtcttcagggcccacctgggccacctgggcagatcagtgaacagaaaagaccaattgatgtagagtttcagaaaggagatcagggacttcctggtgaccgagggcctcctggacctccagggatacgtggtcctccaggtcccccaggtggtgagaaaggtgagaagggtgagcaaggagagccaggcaaaagaggtaaaccaggcaaagatggagaaaatggccaaccaggaattcctggtttgcctggtgatcctggttaccctggtgaacccggaagggatggtgaaaagggccaaaaaggtgacactggcccacctggacctcctggacttgtaattcctagacctgggactggtataactataggagaaaaaggaaacattgggttgcctgggttgcctggagaaaaaggagagcgaggatttcctggaatacagggtccacctggccttcctggacctccaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtgatgagatatgtgaaccaggccctccaggccccccaggatctccaggtgataaaggactccaaggagaacaaggagtgaaaggtgacaaaggtgacacttgcttcaactgcattggaactggtatttcagggcctccaggtcaacctggtttgccaggtctcccaggtcctccaggatctcttggtttccctggacagaaaggggaaaaaggacaagctggtgcaactggtcccaaaggattaccaggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaaggtaatctttggcatatagttttaggcacatacttgagcagatatgaaattttttaatactatgctcattcctaagttttcattaaacaaactatagaatgacatagtatattctggataagagatttattccttttcttttctcttagatgataagaagatatgttttagggtttgtggccagtccaaaataaaaagggaaaactttctggtttctttgtttttcttctatcttaatttctggatatacttcaataatctcaatgcctagatttttctggtcttgttagtccatccctttttagtgatggagttgttggcctttgtcctaatgttattattaactaatttgaaaagacttataaacaaagtgacagttaatgctaatgtagtagtattcttaactgcgtgtctgagatagtcctctgaatacagttttacaattccctctacttctctcttcaatgtgaaaactttggtggtgtttctcaagtaatcaaatttagaatttgtttcagaatcattggactcaacaggaatttatttgacaattgtttagttccatgtcaaaaagtagtaactccttaatcatgtagtcagaccacagacctaaaaagtattagaaaaggaattttggtactcagttttcatggaaatagtgaaagttcccagtgatataagaatttattgaattgtatgtaaggataatttttcttttaatattatataaaaatactttattttgatcatctaattgatcaatgtcttataaagagataatcaag

SEQ ID NO: 454454 - DNA, 1296 bp, Homo sapiens
  misc_feature (73)..(73): n is a, c, g, or t
ggggactacaggtgcacgctaccacacctggctgatttttttgttttagtagagacagggtttcaaccatgtngcccaggtggtctcaaactcctgagctcaggcaatcccagcactttgggaggctgaggcaggtcgatcacgaggtcaggcgtttaagaccagcttgaccaacatggtgaaaccccatctctacaaaaattagctgggcgtggtggcgcgcgcctgtaatcccagctactcaggaggctgaggcagatgaattgcttgaatccaggaggcagaggttgcaatgagccaagattgtgccacggcactccagcctgggcagcagagtgagactctctctcaaaaaaacaaaacttggctgttaatgtctgccctctgaattcagacacactatattagaccagaccaccatgtgtcattgtgtgtgtgtgtgtgtgtgtgtgtgtttgcgtgcgcatgtgtagaggagagagcagggtccctgagataatggtttccaaactgtatcgtagccgtccacaaagatgtaatccaaatctatttttctcacgtgtttaaaaaactgaaaagtgactactcagatatgttggaagtcacatcgaagactatcagaatattaccttgtgttcataggttaacttgtttttgtacacgtcttagttatttcaggcatctctttgcttaaaattgagtttcttgtaaatgtgactgatgagcgaggttagaagtggaagaaattcctgtgcatgttctataatctgacaccctgaaagcaagtttcctttcgtcattcacatgctcttgttctgccgtgactgttcaggtgtatggtagtaagtaaatgtattaacatggtgaacagtagtaatattctatcatagagtattagcccttgcaagttttcagggcgtcttttccgacttcagtttttgtgataaagaatgtgaacagttgttagatgttctcagtgattcaactttaaaacaaatttctcgtgatgattcatttcaaaatcctgagtgagtctgactgaaaaatacgagagaaaagagagtggtttccgtttgcagctacacagctgtgtgcatcgacgttctcctggggtgtgtgccaagcgaaacccaggggtgaattggattcttgaagagaccaaagcctgtaactgtccagcttctaatttcaaaacgggtccattagggcttcgttgtgttaacaagttgacaccatgactagtaaatgtaaacgtgtatgtataaaataaagtttagcaaattaagtgtcctgtta

SEQ ID NO: 454455 - DNA, 1779 bp, Homo sapiens
  misc_feature (1553)..(1553): n is a, c, g, or t
  misc_feature (1742)..(1742): n is a, c, g, or t
  misc_feature (1770)..(1770): n is a, c, g, or t
gagcctaccaaacctttggttcgcagggctggagctaagtctcgctccaggagaaagaagcagaagaagaactccaggcaggaagcagtgccctggaaaaaacccaaaggcatcaattccaacagcacagctaacttggaggatcctgaggtgggtgatgctgaaagcatggcgatctcagagccgatcaagggcagcagaaagccctgtgtgaataaggaggagttggctttgaagaagcccatggcgaaatgtgcctggaagggtcccagagagccacctcaggatgcccgggcagaagccgagagcccaggaggcgcctctgagtcagaccaagatggtggccatgaaagcccaccaaagaagaaggccgtggcctgggtgtctgccaagaaccccgctcccatgaggaagaagaagaaggtgagcttgggccctgtctcctacgtcttggttgactcagaagatggcaggaagaagccggtgatgccaaagaaagggccaggctcaagaagggaggcatcagatcagaaggcccctcggggccagcagcctgccgaggcaacagcctcaacctctaggggtccgaaggccaagccagaaggctctcctcggcgtgccaccaatgaatccagaaaggtttgatctgggggaccacccatactgaggagttgaaagaacaaggaagacgtaccaagtcaaccaagttctctcttgtcactgaataagactttggactctcttagggcccctgttgatagagatctggccctgaggtaaacgataggtgaggtcttgggtgggagggagttggggaagggaggtggatctctatgcccttttctctaccaggcctgccgtttcaccgccttctctactcaccttctcttcggaggcaggagagttggtaagaggattgggaaaattctagaacattcattcccctttatgcatgagcagggtcactgttacactcatccatgttcagcttttctcccccacgccttgctccctcctcggaatggtcagcgacctctgcaggccctggcatttggaagagctgggtggccctgccatattcttcctcccgccttcctcttgtgtaaccagcggggtaagttaagccaggaccttcgctgcaaacctggttttattgctccttcagtctccagcttccatcctccagttatctagccaggaggtcccaagagttagttttagggaaaaagaatgtctgcctagacctcaaagtctttgagttttagagtctgttagtaaaaatggcactttgattcccatttgggatgagccctctcaggaatcctgtggggaaggggggtgattatagggaaggacgcaggcattcctaggtccccagctctaattccatccatctacccaactgtcaccatctttgcaccaaactgtcaccatctttgcagcagaaggtcactactcacattatagtaagaggggaaaaaaatcttttaaaacttggctggccaatgttaagtattttaaaagtcattttaaaatacttaacattggccagnaagttttaagtattttaaaagtcattttaaaatatttgtcattgatgaaacttggttttcaggcacacgtaattgctttccctctcttcttgttgattagggtgttaaacctcttattttaacttcaagtccctaggattaggatggtccctttggtccccggatgttttgcagtaattggcttccctngggttaataaaggtattttttggaatanacctcgggg

SEQ ID NO: 454456 - DNA, 2720 bp, Homo sapiens
gagcctaccaaacctttggttcgcagggctggagctaagtctcgctccaggagaaagaagcagaagaagaactccaggcaggaagcagtgccctggaaaaaacccaaaggcatcaattccaacagcacagctaacttggaggatcctgaggtgggtgatgctgaaagcatggcgatctcagagccgatcaagggcagcagaaagccctgtgtgaataaggaggagttggctttgaagaagcccatggcgaaatgtgcctggaagggtcccagagagccacctcaggatgcccgggcagaagccgagagcccaggaggcgcctctgagtcagaccaagatggtggccatgaaagcccaccaaagaagaaggccgtggcctgggtgtctgccaagaaccccgctcccatgaggaagaagaagaaggtgagcttgggccctgtctcctacgtcttggttgactcagaagatggcaggaagaagccggtgatgccaaagaaagggccaggctcaagaagggaggcatcagatcagaaggcccctcggggccagcagcctgccgaggcaacagcctcaacctctaggggtccgaaggccaagccagaaggctctcctcggcgtgccaccaatgaatccagaaaggtttgatctgggggaccacccatactgaggagttgaaagaacaaggaagacgtaccaagtcaaccaagttctctcttgtcactgaataagactttggactctcttagggcccctgttgatagagatctggccctgaggtaaacgataggtgaggtcttgggtgggagggagttggggaagggaggtggatctctatgcccttttctctaccaggcctgccgtttcaccgccttctctactcaccttctcttcggaggcaggagagttggtaagaggattgggaaaattctagaacattcattcccctttatgcatgagcagggtcactgttacactcatccatgttcagcttttctcccccacgccttgctccctcctcggaatggtcagcgacctctgcaggccctggcatttggaagagctgggtggccctgccatattcttcctcccgccttcctcttgtgtaaccagcggggtaagttaagccaggaccttcgctgcaaacctggttttattgctccttcagtctccagcttccatcctccagttatctagccaggaggtcccaagagttagttttagggaaaaagaatgtctgcctagacctcaaagtctttgagttttagagtctgttagtaaaaatggcactttgattcccatttgggatgagccctctcaggaatcctgtggggaaggggggtgattatagggaaggacgcaggcattcctaggtccccagctctaattccatccatctacccaactgtcaccatctttgcaccaaactgtcaccatctttgcagcagaaggtcactactcacattatagtaagaggggaaaaaaatcttttaaaacttggctgttggccgggcacggtggctcacgcctgtaatcccagcactttgggaggctgaggcaggtcgatcacgaggtcaggcgtttaagaccagcttgaccaacatggtgaaaccccatctctacaaaaattagctgggcgtggtggcgcgcgcctgtaatcccagctactcaggaggctgaggcagatgaattgcttgaatccaggaggcagaggttgcaatgagccaagattgtgccacggcactccagcctgggcagcagagtgagactctctctcaaaaaaacaaaacttggctgttaatgtctgccctctgaattcagacacactatattagaccagaccaccatgtgtcattgtgtgtgtgtgtgtgtgtgtgtgtgtttgcgtgcgcatgtgtagaggagagagcagggtccctgagataatggtttccaaactgtatcgtagccgtccacaaagatgtaatccaaatctatttttctcacgtgtttaaaaaactgaaaagtgactactcagatatgttggaagtcacatcgaagactatcagaatattaccttgtgttcataggttaacttgtttttgtacacgtcttagttatttcaggcatctctttgcttaaaattgagtttcttgtaaatgtgactgatgagcgaggttagaagtggaagaaattcctgtgcatgttctataatctgacaccctgaaagcaagtttcctttcgtcattcacatgctcttgttctgccgtgactgttcaggtgtatggtagtaagtaaatgtattaacatggtgaacagtagtaatattctatcatagagtattagcccttgcaagttttcagggcgtcttttccgacttcagtttttgtgataaagaatgtgaacagttgttagatgttctcagtgattcaactttaaaacaaatttctcgtgatgattcatttcaaaatcctgagtgagtctgactgaaaaatacgagagaaaagagagtggtttccgtttgcagctacacagctgtgtgcatcgacgttctcctggggtgtgtgccaagcgaaacccaggggtgaattggattcttgaagagaccaaagcctgtaactgtccagcttctaatttcaaaacgggtccattagggcttcgttgtgttaacaagttgacaccatgactagtaaatgtaaacgtgtatgtataaaataaagtttagcaaattaagtgtcctgtta

SEQ ID NO: 454457 - DNA, 1484 bp, Homo sapiens
gagcctaccaaacctttggttcgcagggctggagctaagtctcgctccaggagaaagaagcagaagaagaactccaggcaggaagcagtgccctggaaaaaacccaaaggcatcaattccaacagcacagctaacttggaggatcctgaggtgggtgatgctgaaagcatggcgatctcagagccgatcaagggcagcagaaagccctgtgtgaataaggaggagttggctttgaagaagcccatggcgaaatgtgcctggaagggtcccagagagccacctcaggatgcccgggcagaagccgagagcccaggaggcgcctctgagtcagaccaagatggtggccatgaaagcccaccaaagaagaaggccgtggcctgggtgtctgccaagaaccccgctcccatgaggaagaagaagaaggtgagcttgggccctgtctcctacgtcttggttgactcagaagatggcaggaagaagccggtgatgccaaagaaagggccaggctcaagaagggaggcatcagatcagaaggcccctcggggccagcagcctgccgaggcaacagcctcaacctctaggggtccgaaggccaagccagaaggctctcctcggcgtgccaccaatgaatccagaaaggtttgatctgggggaccacccatactgaggagttgaaagaacaaggaagacgtaccaagtcaaccaagttctctcttgtcactgaataagactttggactctcttagggcccctgttgatagagatctggccctgaggtaaacgataggtgaggtcttgggtgggagggagttggggaagggaggtggatctctatgcccttttctctaccaggcctgccgtttcaccgccttctctactcaccttctcttcggaggcaggagagttggtaagaggattgggaaaattctagaacattcattcccctttatgcatgagcagggtcactgttacactcatccatgttcagcttttctcccccacgccttgctccctcctcggaatggtcagcgacctctgcaggccctggcatttggaagagctgggtggccctgccatattcttcctcccgccttcctcttgtgtaaccagcggggtaagttaagccaggaccttcgctgcaaacctggttttattgctccttcagtctccagcttccatcctccagttatctagccaggaggtcccaagagttagttttagggaaaaagaatgtctgcctagacctcaaagtctttgagttttagagtctgttagtaaaaatggcactttgattcccatttgggatgagccctctcaggaatcctgtggggaaggggggtgatctccctttttgtttcctccccgccccccattatctcttgggtcaatagggttaccacttgtatcccgcatcctatttcaaaaggggcaagctccctctctcttttctcaacccttaagtgaccttttgttgtggctcttct

SEQ ID NO: 454458 - DNA, 542 bp, Homo sapiens
aagaggtcctactgaggtgtggcaggatcacaggccagtggaaaaagggcaggtcagatgggcaaggcccaggactttcagattaactgagaggatatcgaggccaagcatggcagggggaaggtcagtgggtgtcaagagacccaggtctgaccccggatgtttgctccatgtgacaaaagcaggcctgtctcaggaccttttcttttcttttttccttctttttttttttgacacggagtttcgctcttgttgtccaggctagagtgcaatggcatgatcccagctcaccgcaacgtctacctcccaggaagtggagtgacaggggacaggtagagagaagggggcccaatggccagggagtgaaggaggtggcgttgctgagagcagtctgcacatgcttctgtctgagtgcaggaaggtgttccagggtcgaaattacacttctcgtacctggagacgctgtttgtgggagcactgggctcatgcctggcacacaataggtctgcaataaaccatggttaaatcctgaaaaaaaaagt

SEQ ID NO: 454459 - DNA, 1859 bp, Homo sapiens
aagaggtcctactgaggtgtggcaggatcacaggccagtggaaaaagggcaggtcagatgggcaaggcccaggactttcagattaactgagaggatatcgaggccaagcatggcagggggaaggtcagtgggtgtcaagagacccaggtctgaccccggatgtttgctccatgtgacaaaagcaggcctgtctcaggaccttttcttttcttttttccttctttttttttttgacacggagtttcgctcttgttgtccaggctagagtgcaatggcatgatcccagctcaccgcaacgtctacctcccaggttcaaatcattctcttgcctcagactcccgagtagctgggattacaggcacatgccaccatgcctggctaattttgtatatttagtagaaacagggtttcaccatgctggccatgctggtctcgaactcctgacctcaggtgttccacctacctcagcctcccaaagtgctggggttacaggtgtgagccatcgcgcctggccaggacctttgtttcttatctacatattggaagatttggtcctgatgtcctttgaggcttctttagctctagttctctgacacttcagcctatatcacagctaacttcctcagtctcatctattccttatgctccagcccctggcaatttgcctcaagatgggggtttgaaaataactttacctgactcaaggagtgtctggagcacctcctagtctaagtctgcaagctccagttcttgcctaaaaccatgccagtggccacccttgggcttcagacagctctggggccttttgaccacaagccagcccctcgccctctctgtggcatagtcttctctgccccaggactgcagggcggcttcctccaaggcttccaaggctcaaaagaaatttggctccatccaagaaggctccagctcccctactggcccctggcttcaggcccacacccctgggccaggcccagagagtgtgtctcaggagaattcaatgggctctagagagacacacagaaagtttggcatttggaaatttcaaggatgtatgtatgctcacgtatggagcaggttgtcctggtccctgggtgcagggaagtgggctgcagggaagtggattggaggggagcttgaggaatataaggagcgggggtggagactcaggctatggacaaggacagccccaaggttgggaagacctggccttagtcgtcctcagcctaggggcagggcagtgaagaaagctctccccgctcctgctgtaatgacccagagtagcctccccaggccggcatcttatgtgtgtcttccaccatcctcatggtggcacttttctaggcctgtctcccagcattgtgcaaggctcggaagagaaccaggaagtgaaactgggtgaaaacagaaagctcaatggatgggctaggttcccagatcattagggcagagtttgcacgtcctctggtcactggaatccacccagcccacgaatcatctccctcttgaaggattttatttctactgggttttggaacaaactcctgctgagaccccacagccagaaactgaaagcagcagctccccaaagcctggaaaatccctaagagaaggcctggggcaggaagtggagtgacaggggacaggtagagagaagggggcccaatggccagggagtgaaggaggtggcgttgctgagagcagtctgcacatgcttctgtctgagtgcaggaaggtgttccagggtcgaaattacacttctcgtacctggagacgctgtttgtgggagcactgggctcatgcctggcacacaataggtctgcaataaaccatggttaaatcctgaaaaaaaaagt

SEQ ID NO: 454460 - DNA, 1249 bp, Homo sapiens
aagaggtcctactgaggtgtggcaggatcacaggccagtggaaaaagggcaggtcagatgggcaaggcccaggactttcagattaactgagaggatatcgaggccaagcatggcagggggaaggtcagtgggtgtcaagagacccaggtctgaccccggatgtttgctccatgtgacaaaagcaggcctgtctcaggaccttttcttttcttttttccttctttttttttttgacacggagtttcgctcttgttgtccaggctagagtgcaatggcatgatcccagctcaccgcaacgtctacctcccaggttcaaatcattctcttgcctcagactcccgagtagctgggattacaggcacatgccaccatgcctggctaattttgtatatttagtagaaacagggtttcaccatgctggccatgctggtctcgaactcctgacctcaggtgttccacctacctcagcctcccaaagtgctggggttacaggtgtgagccatcgcgcctggccaggacctttgtttcttatctacatattggaagatttggtcctgatgtcctttgaggcttctttagctctagttctctgacacttcagcctatatcacagctaacttcctcagtctcatctattccttatgctccagcccctggcaatttgcctcaagatgggggtttgaaaataactttacctgactcaaggagtgtctggagcacctcctagtctaagtctgcaagctccagttcttgcctaaaaccatgccagtggccacccttgggcttcagacagctctggggccttttgaccacaagccagcccctcgccctctctgtggcatagtcttctctgccccaggactgcagggcggcttcctccaaggcttccaaggctcaaaagaaatttggctccatccaagaaggctccagctcccctactggcccctggcttcaggcccacacccctgggccaggcccagagagtgtgtctcaggagaattcaatgggctctagagagacacacagaaagtttggcatttggaaatttcaaggatgtatgtatgctcacgtatggagcaggttgtcctggtccctgggtgcagggaagtgggctgcagggaagtggattggaggggagcttgaggaatataaggagcgggggtggagactcaggctatggacaagcagcagaggcaggacaagcagagaggcaggacaagcagcagaggcaggacaagcaggggacctt

SEQ ID NO: 454461 - DNA, 638 bp, Homo sapiens
aattcggcaccaggggaagaggaactctaacacttctctcctccactctgagcccccttgctgattccctgctttggtccaatcccctgttgccctgtctctgcagtggatggggagtgggactcgtggggggagtggagcccctgtatccgacggaacatgaagtccatcagctgtcaagaaatcccgggccagcagtcacgcgggaggacctgcaggggccgcaagtttgacggacatcgatgtgccgggcaacagcaggatatccggcactgctacagcatccagcactgccccttgaaaggatcatggtcagagtggagtacctgggggctgtgcatgcccccctgtggacctaatcctacccgtgcccgccagcgcctctgcacacccttgctccccaagtacccgcccaccgtttccatggtcgaaggtcagggcgagaagaacgtgaccttctgggggagaccgctgccacggtgtgaggagctacaagggcagaagctggtggtggaggagaaacgaccatgtctacacgtgcctgcttgcaaagaccctgaggaagaggaactctaacacttctctcctccactctgagccccctgaccttccaaacctcaataaactagcctcttcga

SEQ ID NO: 454462 - DNA, 1714 bp, Homo sapiens
gagcaccgcacactcacttcaccctggttcaacacccccacgaggttgaccccgtcattatgttagagattatgcattttccacatagggaaactgaggctcaggggtgttaagtgactcacccaaggtcacacggctaggaagttgctgcacgctcctatgctccatttcctctgggagcctatcaacccagataaagcgggacctcctctctggtagaggtgcagggggcagtactcaacatgatcacagagggagcgcaggcccctcgattgttgctgccgccgctgctcctgctgctcaccctgccagccacaggctcagaccccgtgctctgcttcacccagtatgaagaatcctccggcaagtgcaagggcctcctggggggtggtgtcagcgtggaagactgctgtctcaacactgcctttgcctaccagaaacgtagtggtgggctctgtcagccttgcaggtccccacgatggtccctgtggtccacatgggccccctgttcggtgacgtgctctgagggctcccagctgcggtaccggcgctgtgtgggctggaatgggcagtgctctggaaaggtggcacctgggaccctggagtggcagctccaggcctgtgaggaccagcagtgctgtcctgagatgggcggctggtctggctgggggccctgggagccttgctctgtcacctgctccaaagggacccggacccgcaggcgagcctgtaatcaccctgctcccaagtgtgggggccactgcccaggacaggcacaggaatcagaggcctgtgacacccagcaggtctgccccacacacggggcctgggccacctggggcccctggaccccctgctcagcctcctgccacggtggaccccacgaacctaaggagacacgaagccgcaagtgttctgcacctgagccctcccagaaacctcctgggaagccctgcccggggctagcctacgagcagcggaggtgcaccggcctgccaccctgcccagtggctgggggctgggggccttggggccctgtgagcccctgccctgtgacctgtggcctgggccagaccatggaacaacggacgtgcaatcaccctgtgccccagcatgggggccccttctgtgctggcgatgccacccggacccacatctgcaacacagctgtgccctgccctgtggatggggagtgggactcgtggggggagtggagcccctgtatccgacggaacatgaagtccatcagctgtcaagaaatcccgggccagcagtcacgcgggaggacctgcaggggccgcaagtttgacggacatcgatgtgccgggcaacagcaggatatccggcactgctacagcatccagcactgccccttgaaaggatcatggtcagagtggagtacctgggggctgtgcatgcccccctgtggacctaatcctacccgtgcccgccagcgcctctgcacacccttgctccccaagtacccgcccaccgtttccatggtcgaaggtcagggcgagaagaacgtgaccttctgggggagaccgctgccacggtgtgaggagctacaagggcagaagctggtggtggaggagaaacgaccatgtctacacgtgcctgcttgcaaagaccctgaggaagaggaactctaacacttctctcctccactctgagccccctgaccttccaaacctcaataaactagcctcttcga

SEQ ID NO: 454463 - DNA, 300 bp, Homo sapiens
caataagaattgaatgcattcttgccttccctgagattctcccttccgttcctccccacccctaatgcctcaggcccaccgtttccatggtcgaaggtcagggcgagaagaacgtgaccttctgggggagaccgctgccacggtgtgaggagctacaagggcagaagctggtggtggaggagaaacgaccatgtctacacgtgcctgcttgcaaagaccctgaggaagaggaactctaacacttctctcctccactctgagccccctgaccttccaaacctcaataaactagcctcttcg

SEQ ID NO: 454464 - DNA, 1585 bp, Homo sapiens
ctcccagttcctcctgcctctaggttcctctttccctgctgattccaggagcctatcaacccagataaagcgggacctcctctctggtagaggtgcagggggcagtactcaacatgatcacagagggagcgcaggcccctcgattgttgctgccgccgctgctcctgctgctcaccctgccagccacaggctcagaccccgtgctctgcttcacccagtatgaagaatcctccggcaagtgcaagggcctcctggggggtggtgtcagcgtggaagactgctgtctcaacactgcctttgcctaccagaaacgtagtggtgggctctgtcagccttgcaggtccccacgatggtccctgtggtccacatgggccccctgttcggtgacgtgctctgagggctcccagctgcggtaccggcgctgtgtgggctggaatgggcagtgctctggaaaggtggcacctgggaccctggagtggcagctccaggcctgtgaggaccagcagtgctgtcctgagatgggcggctggtctggctgggggccctgggagccttgctctgtcacctgctccaaagggacccggacccgcaggcgagcctgtaatcaccctgctcccaagtgtgggggccactgcccaggacaggcacaggaatcagaggcctgtgacacccagcaggtctgccccacacacggggcctgggccacctggggcccctggaccccctgctcagcctcctgccacggtggaccccacgaacctaaggagacacgaagccgcaagtgttctgcacctgagccctcccagaaacctcctgggaagccctgcccggggctagcctacgagcagcggaggtgcaccggcctgccaccctgcccagtggctgggggctgggggccttggggccctgtgagcccctgccctgtgacctgtggcctgggccagaccatggaacaacggacgtgcaatcaccctgtgccccagcatgggggccccttctgtgctggcgatgccacccggacccacatctgcaacacagctgtgccctgccctgtggatggggagtgggactcgtggggggagtggagcccctgtatccgacggaacatgaagtccatcagctgtcaagaaatcccgggccagcagtcacgcgggaggacctgcaggggccgcaagtttgacggacatcgatgtgccgggcaacagcaggatatccggcactgctacagcatccagcactgccccttgaaaggatcatggtcagagtggagtacctgggggctgtgcatgcccccctgtggacctaatcctacccgtgcccgccagcgcctctgcacacccttgctccccaagtacccgcccaccgtttccatggtcgaaggtcagggcgagaagaacgtgaccttctgggggagaccgctgccacggtgtgaggagctacaagggcagaagctggtggtggaggagaaacgaccatgtctacacgtgcctgcttgcaaagaccctgaggaagaggaactctaacacttctctcctccactctgagccccctgaccttccaaacctcaataaactagcctcttcga

SEQ ID NO: 454465 - DNA, 1548 bp, Homo sapiens
ctcccagttcctcctgcctctaggttcctctttccctgctgattccaggagcctatcaacccagataaagcgggacctcctctctggtagaggtgcagggggcagtactcaacatgatcacagagggagcgcaggcccctcgattgttgctgccgccgctgctcctgctgctcaccctgccagccacaggctcagaccccgtgctctgcttcacccagtatgaagaatcctccggcaagtgcaagggcctcctggggggtggtgtcagcgtggaagactgctgtctcaacactgcctttgcctaccagaaacgtagtggtgggctctgtcagccttgcaggtccccacgatggtccctgtggtccacatgggccccctgttcggtgacgtgctctgagggctcccagctgcggtaccggcgctgtgtgggctggaatgggcagtgctctggaaaggtggcacctgggaccctggagtggcagctccaggcctgtgaggaccagcagtgctgtcctgagatgggcggctggtctggctgggggccctgggagccttgctctgtcacctgctccaaagggacccggacccgcaggcgagcctgtaatcaccctgctcccaagtgtgggggccactgcccaggacaggcacaggaatcagaggcctgtgacacccagcaggtctgccccacacacggggcctgggccacctggggcccctggaccccctgctcagcctcctgccacggtggaccccacgaacctaaggagacacgaagccgcaagtgttctgcacctgagccctcccagaaacctcctgggaagccctgcccggggctagcctacgagcagcggaggtgcaccggcctgccaccctgcccagctgccctgtgacctgtggcctgggccagaccatggaacaacggacgtgcaatcaccctgtgccccagcatgggggccccttctgtgctggcgatgccacccggacccacatctgcaacacagctgtgccctgccctgtggatggggagtgggactcgtggggggagtggagcccctgtatccgacggaacatgaagtccatcagctgtcaagaaatcccgggccagcagtcacgcgggaggacctgcaggggccgcaagtttgacggacatcgatgtgccgggcaacagcaggatatccggcactgctacagcatccagcactgccccttgaaaggatcatggtcagagtggagtacctgggggctgtgcatgcccccctgtggacctaatcctacccgtgcccgccagcgcctctgcacacccttgctccccaagtacccgcccaccgtttccatggtcgaaggtcagggcgagaagaacgtgaccttctgggggagaccgctgccacggtgtgaggagctacaagggcagaagctggtggtggaggagaaacgaccatgtctacacgtgcctgcttgcaaagaccctgaggaagaggaactctaacacttctctcctccactctgagccccctgaccttccaaacctcaataaactagcctcttcga

SEQ ID NO: 454466 - DNA, 3216 bp, Homo sapiens
gtaatcaatataaaattattaatgagatattttgcattcttttttttgtatggcttcaaaatctggtgtgcatttctcacttatagctcatttcaatttgtattagccacatttcaaatgctcagcagccacatgtgacgagggaggacactgttggacagcacaggtctagacctcagtagctctcccttcagattaatgccatgtgaatcgaatgggtggtatgaagaatggatgctgagtccttggagaatccacttgcacttgggtggtgactgataagaagccctagctgtgccatttcctgatacatgactgtttttgaagttatggactcaggatctagaagactgcaaatccccaaatacgtctaacacccaagctcacgccaggaccgtgcttccgggcctgtgtgagaacctaagctatggaacctgtcaacttctagggctgcagattcgttgggccctcacatgtggcccgtggaaaggaggcatcactcgaggaagaggagggcttctagaggggcaaggccacccaactaggggcttcttgagggcaggtgctccaaatggccgcttcctgagggcagcgggtcctcttgtggcctcaggcagggccctgaaaccggcctcacgtgtttgcagcgcgaactcctgtgcttccaccaagcgctctcggggatgcgggggtggtgtcagcgccccggccccagcccgcaccccgaagtggctccaaggctgcaggtgtgaggggcgtgcccagggctcggcccgcgccgccccatgtgacccggtccgacatggtgtcgcctcctcccggggcggcggcggtggcggctcgggctgggctccgcgtcgggccggccccgcggccgctcatgggcagccagggccgctcggggccccccgggaacggcgggcccggcgagggcgagggcggagaggcgaggaagctgcaggaagggagggtggcgagggggaagcgaaggaaggggaaggggaagggaaaagcgagagcggggcaaggcggaagaggaagcggggcggaagggaagcccgggccgcagacggcgaaggaggcagccgggccgggggctgacgcgggagcgagggcatgcccaagggaggaagcagagggaggcagaagcgtggaggaaggggcgagaggcatcgtcaagggagtcgaggggagcgcaggggccgggaaggaggcacaaggaagagagtatgggaagaaggaggaatggagggtcagggctaggcggcgggagggcgccaggccgggaagagcacagggacgagggggtcaggcttgggccgacatcgcggggacaggggtggccatggcggcggcggccggggaggaggaggaggaggaggaggcggctcgggagtcggctgcccgcccggccgcggggcctgcgctctggcgcctgccggaggagctgctgctgctcatctgctcctacctggacatgcgggccctcggccgcctggcccaggtgtgccgctggctgcggcgcttcaccagctgcgatctgctctggcgccggatagcccgggcctcgctcaactccggcttcacgcggctcggcaccgacctgatgaccagtgtcccagtgaaggaacgagtgaaggtgtctcagaactggagactggggcgctgccgagaggggattctgctgaagtggagatgcagtcagatgccctggatgcagctagaggatgattctctgtacatatcccaggctaatttcatcctggcctaccagttccgtccagatggtgccagcttgaatcgtcggcctctgggagtctttgctgggcatgatgaggacgtttgccactttgtgctggccaactcgcatattgttagtgcaggaggggatgggaagattggcattcataagattcacagcaccttcactgtcaagtactcggctcatgaacaggaggtgaactgtgtggattgcaaagggggcatcattgtgagtggctccagggacaggacggccaaggtgtggcctttggcctcaggccggctggggcagtgcttacacaccatccagactgaagaccgagtctggtccattgctatcagcccattactcagctcttttgtgacagggacggcttgttgcgggcacttctcacccctgagaatctgggacctcaacagtgggcagctgatgacacacttgggcagtgactttcccccaggggctggggtgctggatgtcatgtatgagtcccctttcacactgctgtcctgtggctatgacacctatgttcgctactgggacctccgcaccagcgtccggaaatgtgtcatggagtgggaggagccccacgacagcaccctgtactgcctgcagacagatggcaaccacctgctggccacaggttcctcctactacggtgttgtacggctgtgggaccggcgtcaaagggcctgcctgcacgccttcccgctgacgtcgactcccctcagcagccctgtgtactgcctgcgtctcaccaccaagcatctctatgctgccctgtcttacaacctccacgtcctggattttcaaaacccatgaccgtcagggccacccctgcctctgggccagggaaaccagctactcagggacttctcttgcctggagggtgcagtgatagctcctcctcactgccccactgtgctcctgggcctgtgaccccagtgctcaggcaccttgcactagaggcttctgactcctgggactttggagcttaccagagatgcagtccctcccaggaacctgttggagaggcaggacctgctgctttagagtgcggctgaacccgggccttgcgtccctgtttggccagagcaaggatctggcctggagaggcccatcctataccccttattagagccatgacagcctacagagtgaggtgaggtgctcccaccttcccagatggttcctttctgccccttcctggaaggaaaggtgaggctgccaatagcctcctggcaccagccagacctcacccttgaccaacctctcggggctgggggttcattcctggggcactgtggcctggttttgctttgaaaccaagaaagagcaaagggaacccagcagttctgagtgagttctgagccagccctacctcaggctggctgttgagacatgctacaattttcatttttgtaaaaataaagcttgattgttcacaaaaaaaa

SEQ ID NO: 454467 - DNA, 2357 bp, Homo sapiens
gtaatcaatataaaattattaatgagatattttgcattcttttttttgtatggcttcaaaatctggtgtgcatttctcacttatagctcatttcaatttgtattagccacatttcaaatgctcagcagccacatgtgacgagggaggacactgttggacagcacaggtctagacctcagtagctctcccttcagattaatgccatgtgaatcgaatgggtggtatgaagaatggatgctgagtccttggagaatccacttgcacttgggtggtgactgataagaagccctagctgtgccatttcctgatacatgactgtttttgaagttatggactcaggatctagaagactgcaaatccccaaatacgtctaacacccaagctcacgccaggaccgtgcttccgggcctgtgtgagaacctaagctatggaacctgtcaacttctagggctgcagattcgttgggccctcacatgtggcccgtggaaaggaggcatcactcgaggaagaggagggcttctagaggggcaaggccacccaactaggggcttcttgagggcaggtgctccaaatggccgcttcctgagggcagcgggtcctcttgtggcctcaggcagggccctgaaaccggcctcacgtgtttgcagcgcgaactcctgtgcttccaccaagcgctctcggggatgcgggggtggtgtcagcgccccggccccagcccgcaccccgaagtggctccaaggctgcaggatgaccagtgtcccagtgaaggaacgagtgaaggtgtctcagaactggagactggggcgctgccgagaggggattctgctgaagtggagatgcagtcagatgccctggatgcagctagaggatgattctctgtacatatcccaggctaatttcatcctggcctaccagttccgtccagatggtgccagcttgaatcgtcggcctctgggagtctttgctgggcatgatgaggacgtttgccactttgtgctggccaactcgcatattgttagtgcaggaggggatgggaagattggcattcataagattcacagcaccttcactgtcaagtactcggctcatgaacaggaggtgaactgtgtggattgcaaagggggcatcattgtgagtggctccagggacaggacggccaaggtgtggcctttggcctcaggccggctggggcagtgcttacacaccatccagactgaagaccgagtctggtccattgctatcagcccattactcagctcttttgtgacagggacggcttgttgcgggcacttctcacccctgagaatctgggacctcaacagtgggcagctgatgacacacttgggcagtgactttcccccaggggctggggtgctggatgtcatgtatgagtcccctttcacactgctgtcctgtggctatgacacctatgttcgctactgggacctccgcaccagcgtccggaaatgtgtcatggagtgggaggagccccacgacagcaccctgtactgcctgcagacagatggcaaccacctgctggccacaggttcctcctactacggtgttgtacggctgtgggaccggcgtcaaagggcctgcctgcacgccttcccgctgacgtcgactcccctcagcagccctgtgtactgcctgcgtctcaccaccaagcatctctatgctgccctgtcttacaacctccacgtcctggattttcaaaacccatgaccgtcagggccacccctgcctctgggccagggaaaccagctactcagggacttctcttgcctggagggtgcagtgatagctcctcctcactgccccactgtgctcctgggcctgtgaccccagtgctcaggcaccttgcactagaggcttctgactcctgggactttggagcttaccagagatgcagtccctcccaggaacctgttggagaggcaggacctgctgctttagagtgcggctgaacccgggccttgcgtccctgtttggccagagcaaggatctggcctggagaggcccatcctataccccttattagagccatgacagcctacagagtgaggtgaggtgctcccaccttcccagatggttcctttctgccccttcctggaaggaaaggtgaggctgccaatagcctcctggcaccagccagacctcacccttgaccaacctctcggggctgggggttcattcctggggcactgtggcctggttttgctttgaaaccaagaaagagcaaagggaacccagcagttctgagtgagttctgagccagccctacctcaggctggctgttgagacatgctacaattttcatttttgtaaaaataaagcttgattgttcacaaaaaaaa

SEQ ID NO: 454468 - DNA, 1660 bp, Homo sapiens
aactgtgctgtgtcgaaccgtatgtgtgccggtggctcggcaccgacctgatgaccagtgtcccagtgaaggaacgagtgaaggtgtctcagaactggagactggggcgctgccgagaggggattctgctgaagtggagatgcagtcagatgccctggatgcagctagaggatgattctctgtacatatcccaggctaatttcatcctggcctaccagttccgtccagatggtgccagcttgaatcgtcggcctctgggagtctttgctgggcatgatgaggacgtttgccactttgtgctggccaactcgcatattgttagtgcaggaggggatgggaagattggcattcataagattcacagcaccttcactgtcaagtactcggctcatgaacaggaggtgaactgtgtggattgcaaagggggcatcattgtgagtggctccagggacaggacggccaaggtgtggcctttggcctcaggccggctggggcagtgcttacacaccatccagactgaagaccgagtctggtccattgctatcagcccattactcagctcttttgtgacagggacggcttgttgcgggcacttctcacccctgagaatctgggacctcaacagtgggcagctgatgacacacttgggcagtgactttcccccaggggctggggtgctggatgtcatgtatgagtcccctttcacactgctgtcctgtggctatgacacctatgttcgctactgggacctccgcaccagcgtccggaaatgtgtcatggagtgggaggagccccacgacagcaccctgtactgcctgcagacagatggcaaccacctgctggccacaggttcctcctactacggtgttgtacggctgtgggaccggcgtcaaagggcctgcctgcacgccttcccgctgacgtcgactcccctcagcagccctgtgtactgcctgcgtctcaccaccaagcatctctatgctgccctgtcttacaacctccacgtcctggattttcaaaacccatgaccgtcagggccacccctgcctctgggccagggaaaccagctactcagggacttctcttgcctggagggtgcagtgatagctcctcctcactgccccactgtgctcctgggcctgtgaccccagtgctcaggcaccttgcactagaggcttctgactcctgggactttggagcttaccagagatgcagtccctcccaggaacctgttggagaggcaggacctgctgctttagagtgcggctgaacccgggccttgcgtccctgtttggccagagcaaggatctggcctggagaggcccatcctataccccttattagagccatgacagcctacagagtgaggtgaggtgctcccaccttcccagatggttcctttctgccccttcctggaaggaaaggtgaggctgccaatagcctcctggcaccagccagacctcacccttgaccaacctctcggggctgggggttcattcctggggcactgtggcctggttttgctttgaaaccaagaaagagcaaagggaacccagcagttctgagtgagttctgagccagccctacctcaggctggctgttgagacatgctacaattttcatttttgtaaaaataaagcttgattgttcacaaaaaaaa

SEQ ID NO: 454469 - DNA, 1695 bp, Homo sapiens
ggcctctgacctctagaggctctgcttacacaccacccagactgaagaccgagtctggtccattgctatcagcccattactcaggatgaccagtgtcccagtgaaggaacgagtgaaggtgtctcagaactggagactggggcgctgccgagaggggattctgctgaagtggagatgcagtcagatgccctggatgcagctagaggatgattctctgtacatatcccaggctaatttcatcctggcctaccagttccgtccagatggtgccagcttgaatcgtcggcctctgggagtctttgctgggcatgatgaggacgtttgccactttgtgctggccaactcgcatattgttagtgcaggaggggatgggaagattggcattcataagattcacagcaccttcactgtcaagtactcggctcatgaacaggaggtgaactgtgtggattgcaaagggggcatcattgtgagtggctccagggacaggacggccaaggtgtggcctttggcctcaggccggctggggcagtgcttacacaccatccagactgaagaccgagtctggtccattgctatcagcccattactcagctcttttgtgacagggacggcttgttgcgggcacttctcacccctgagaatctgggacctcaacagtgggcagctgatgacacacttgggcagtgactttcccccaggggctggggtgctggatgtcatgtatgagtcccctttcacactgctgtcctgtggctatgacacctatgttcgctactgggacctccgcaccagcgtccggaaatgtgtcatggagtgggaggagccccacgacagcaccctgtactgcctgcagacagatggcaaccacctgctggccacaggttcctcctactacggtgttgtacggctgtgggaccggcgtcaaagggcctgcctgcacgccttcccgctgacgtcgactcccctcagcagccctgtgtactgcctgcgtctcaccaccaagcatctctatgctgccctgtcttacaacctccacgtcctggattttcaaaacccatgaccgtcagggccacccctgcctctgggccagggaaaccagctactcagggacttctcttgcctggagggtgcagtgatagctcctcctcactgccccactgtgctcctgggcctgtgaccccagtgctcaggcaccttgcactagaggcttctgactcctgggactttggagcttaccagagatgcagtccctcccaggaacctgttggagaggcaggacctgctgctttagagtgcggctgaacccgggccttgcgtccctgtttggccagagcaaggatctggcctggagaggcccatcctataccccttattagagccatgacagcctacagagtgaggtgaggtgctcccaccttcccagatggttcctttctgccccttcctggaaggaaaggtgaggctgccaatagcctcctggcaccagccagacctcacccttgaccaacctctcggggctgggggttcattcctggggcactgtggcctggttttgctttgaaaccaagaaagagcaaagggaacccagcagttctgagtgagttctgagccagccctacctcaggctggctgttgagacatgctacaattttcatttttgtaaaaataaagcttgattgttcacaaaaaaaa

SEQ ID NO: 454470 - DNA, 1576 bp, Homo sapiens
gctgactctagatgatccctggatagcggatgaggggggatctgctgaagtggagatgcagtcagatgccctggatgcagctagaggatgattctctgtacatatcccaggctaatttcatcctggcctaccagttccgtccagatggtgccagcttgaatcgtcggcctctgggagtctttgctgggcatgatgaggacgtttgccactttgtgctggccaactcgcatattgttagtgcaggaggggatgggaagattggcattcataagattcacagcaccttcactgtcaagtactcggctcatgaacaggaggtgaactgtgtggattgcaaagggggcatcattgtgagtggctccagggacaggacggccaaggtgtggcctttggcctcaggccggctggggcagtgcttacacaccatccagactgaagaccgagtctggtccattgctatcagcccattactcagctcttttgtgacagggacggcttgttgcgggcacttctcacccctgagaatctgggacctcaacagtgggcagctgatgacacacttgggcagtgactttcccccaggggctggggtgctggatgtcatgtatgagtcccctttcacactgctgtcctgtggctatgacacctatgttcgctactgggacctccgcaccagcgtccggaaatgtgtcatggagtgggaggagccccacgacagcaccctgtactgcctgcagacagatggcaaccacctgctggccacaggttcctcctactacggtgttgtacggctgtgggaccggcgtcaaagggcctgcctgcacgccttcccgctgacgtcgactcccctcagcagccctgtgtactgcctgcgtctcaccaccaagcatctctatgctgccctgtcttacaacctccacgtcctggattttcaaaacccatgaccgtcagggccacccctgcctctgggccagggaaaccagctactcagggacttctcttgcctggagggtgcagtgatagctcctcctcactgccccactgtgctcctgggcctgtgaccccagtgctcaggcaccttgcactagaggcttctgactcctgggactttggagcttaccagagatgcagtccctcccaggaacctgttggagaggcaggacctgctgctttagagtgcggctgaacccgggccttgcgtccctgtttggccagagcaaggatctggcctggagaggcccatcctataccccttattagagccatgacagcctacagagtgaggtgaggtgctcccaccttcccagatggttcctttctgccccttcctggaaggaaaggtgaggctgccaatagcctcctggcaccagccagacctcacccttgaccaacctctcggggctgggggttcattcctggggcactgtggcctggttttgctttgaaaccaagaaagagcaaagggaacccagcagttctgagtgagttctgagccagccctacctcaggctggctgttgagacatgctacaattttcatttttgtaaaaataaagcttgattgttcacaaaaaaaa

SEQ ID NO: 454471 - DNA, 2128 bp, Homo sapiens
gtaatcaatataaaattattaatgagatattttgcattcttttttttgtatggcttcaaaatctggtgtgcatttctcacttatagctcatttcaatttgtattagccacatttcaaatgctcagcagccacatgtgacgagggaggacactgttggacagcacaggtctagacctcagtagctctcccttcagattaatgccatgtgaatcgaatgggtggtatgaagaatggatgctgagtccttggagaatccacttgcacttgggtggtgactgataagaagccctagctgtgccatttcctgatacatgactgtttttgaagttatggactcaggatctagaagactgcaaatccccaaatacgtctaacacccaagctcacgccaggaccgtgcttccgggcctgtgtgagaacctaagctatggaacctgtcaacttctagggctgcagattcgttgggccctcacatgtggcccgtggaaaggaggcatcactcgaggaagaggagggcttctagaggggcaaggccacccaactaggggcttcttgagggcaggtgctccaaatggccgcttcctgagggcagcgggtcctcttgtggcctcaggcagggccctgaaaccggcctcacgtgtttgcagcgcgaactcctgtgcttccaccaagcgctctcggggatgcgggggtggtgtcagcgccccggccccagcccgcaccccgaagtggctccaaggctgcaggtgtgaggggcgtgcccagggctcggcccgcgccgccccatgtgacccggtccgacatggtgtcgcctcctcccggggcggcggcggtggcggctcgggctgggctccgcgtcgggccggccccgcggccgctcatgggcagccagggccgctcggggccccccgggaacggcgggcccggcgagggcgagggcggagaggcgaggaagctgcaggaagggagggtggcgagggggaagcgaaggaaggggaaggggaagggaaaagcgagagcggggcaaggcggaagaggaagcggggcggaagggaagcccgggccgcagacggcgaaggaggcagccgggccgggggctgacgcgggagcgagggcatgcccaagggaggaagcagagggaggcagaagcgtggaggaaggggcgagaggcatcgtcaagggagtcgaggggagcgcaggggccgggaaggaggcacaaggaagagagtatgggaagaaggaggaatggagggtcagggctaggcggcgggagggcgccaggccgggaagagcacagggacgagggggtcaggcttgggccgacatcgcggggacaggggtggccatggcggcggcggccggggaggaggaggaggaggaggaggcggctcgggagtcggctgcccgcccggccgcggggcctgcgctctggcgcctgccggaggagctgctgctgctcatctgctcctacctggacatgcgggccctcggccgcctggcccaggtgtgccgctggctgcggcgcttcaccagctgcgatctgctctggcgccggatagcccgggcctcgctcaactccggcttcacgcggctcggcaccgacctgatgaccagtgtcccagtgaaggaacgagtgaaggtgtctcagaactggagactggggcgctgccgagaggggattctgctgaagtggagatgcagtcagatgccctggatgcagctagaggatgattctctgtacatatcccaggctaatttcatcctggcctaccagttccgtccagatggtgccagcttgaatcgtcggcctctgggagtctttgctgggcatgatgaggacgtttgccactttgtgctggccaactcgcatattgttagtgcaggaggggatgggaagattggcattcataagattcaggggattttgcttctagctagcttgatatgaattagtaataggatgtgactgctgtttaccaacaacattcagcaaagattgattgattgattacctaaccatgtaatggacgtttaaaaagtctattcatagaaatatccataactgaatttcccacagtaagttctgcagagactcacttgatgttctggtttgggccatggcaggctc

SEQ ID NO: 454472 - DNA, 1566 bp, Homo sapiens
aaatcatagctaggtcggaggctgtgtgttaactcttatctcgggtacgatgcctgaggtactgctatagcatagagtctctatctatatcccaagccaatttcacttgtacactatgatatatgtgccgatctccgccatattgaatcgtatgtactctcgaaaatctcaggtgaacctgcttaaagagcaatcggcactttgtgctggccaactcgcatattgtagtgcaggaggggatgggaagattggcattcataagattcacagcaccttcactgtcaagtactcggctcatgaacaggaggtgaactgtgtggattgcaaagggggcatcattgtgagtggctccagggacaggacggccaaggtgtggcctttggcctcaggccggctggggcagtgcttacacaccatccagactgaagaccgagtctggtccattgctatcagcccattactcagctcttttgtgacagggacggcttgttgcgggcacttctcacccctgagaatctgggacctcaacagtgggcagctgatgacacacttgggcagtgactttcccccaggggctggggtgctggatgtcatgtatgagtcccctttcacactgctgtcctgtggctatgacacctatgttcgctactgggacctccgcaccagcgtccggaaatgtgtcatggagtgggaggagccccacgacagcaccctgtactgcctgcagacagatggcaaccacctgctggccacaggttcctcctactacggtgttgtacggctgtgggaccggcgtcaaagggcctgcctgcacgccttcccgctgacgtcgactcccctcagcagccctgtgtactgcctgcgtctcaccaccaagcatctctatgctgccctgtcttacaacctccacgtcctggattttcaaaacccatgaccgtcagggccacccctgcctctgggccagggaaaccagctactcagggacttctcttgcctggagggtgcagtgatagctcctcctcactgccccactgtgctcctgggcctgtgaccccagtgctcaggcaccttgcactagaggcttctgactcctgggactttggagcttaccagagatgcagtccctcccaggaacctgttggagaggcaggacctgctgctttagagtgcggctgaacccgggccttgcgtccctgtttggccagagcaaggatctggcctggagaggcccatcctataccccttattagagccatgacagcctacagagtgaggtgaggtgctcccaccttcccagatggttcctttctgccccttcctggaaggaaaggtgaggctgccaatagcctcctggcaccagccagacctcacccttgaccaacctctcggggctgggggttcattcctggggcactgtggcctggttttgctttgaaaccaagaaagagcaaagggaacccagcagttctgagtgagttctgagccagccctacctcaggctggctgttgagacatgctacaattttcatttttgtaaaaataaagcttgattgttcacaaaaaaaa

SEQ ID NO: 454473 - DNA, 3129 bp, Homo sapiens
gtaatcaatataaaattattaatgagatattttgcattcttttttttgtatggcttcaaaatctggtgtgcatttctcacttatagctcatttcaatttgtattagccacatttcaaatgctcagcagccacatgtgacgagggaggacactgttggacagcacaggtctagacctcagtagctctcccttcagattaatgccatgtgaatcgaatgggtggtatgaagaatggatgctgagtccttggagaatccacttgcacttgggtggtgactgataagaagccctagctgtgccatttcctgatacatgactgtttttgaagttatggactcaggatctagaagactgcaaatccccaaatacgtctaacacccaagctcacgccaggaccgtgcttccgggcctgtgtgagaacctaagctatggaacctgtcaacttctagggctgcagattcgttgggccctcacatgtggcccgtggaaaggaggcatcactcgaggaagaggagggcttctagaggggcaaggccacccaactaggggcttcttgagggcaggtgctccaaatggccgcttcctgagggcagcgggtcctcttgtggcctcaggcagggccctgaaaccggcctcacgtgtttgcagcgcgaactcctgtgcttccaccaagcgctctcggggatgcgggggtggtgtcagcgccccggccccagcccgcaccccgaagtggctccaaggctgcaggtgtgaggggcgtgcccagggctcggcccgcgccgccccatgtgacccggtccgacatggtgtcgcctcctcccggggcggcggcggtggcggctcgggctgggctccgcgtcgggccggccccgcggccgctcatgggcagccagggccgctcggggccccccgggaacggcgggcccggcgagggcgagggcggagaggcgaggaagctgcaggaagggagggtggcgagggggaagcgaaggaaggggaaggggaagggaaaagcgagagcggggcaaggcggaagaggaagcggggcggaagggaagcccgggccgcagacggcgaaggaggcagccgggccgggggctgacgcgggagcgagggcatgcccaagggaggaagcagagggaggcagaagcgtggaggaaggggcgagaggcatcgtcaagggagtcgaggggagcgcaggggccgggaaggaggcacaaggaagagagtatgggaagaaggaggaatggagggtcagggctaggcggcgggagggcgccaggccgggaagagcacagggacgagggggtcaggcttgggccgacatcgcggggcctgcgctctggcgcctgccggaggagctgctgctgctcatctgctcctacctggacatgcgggccctcggccgcctggcccaggtgtgccgctggctgcggcgcttcaccagctgcgatctgctctggcgccggatagcccgggcctcgctcaactccggcttcacgcggctcggcaccgacctgatgaccagtgtcccagtgaaggaacgagtgaaggtgtctcagaactggagactggggcgctgccgagaggggattctgctgaagtggagatgcagtcagatgccctggatgcagctagaggatgattctctgtacatatcccaggctaatttcatcctggcctaccagttccgtccagatggtgccagcttgaatcgtcggcctctgggagtctttgctgggcatgatgaggacgtttgccactttgtgctggccaactcgcatattgttagtgcaggaggggatgggaagattggcattcataagattcacagcaccttcactgtcaagtactcggctcatgaacaggaggtgaactgtgtggattgcaaagggggcatcattgtgagtggctccagggacaggacggccaaggtgtggcctttggcctcaggccggctggggcagtgcttacacaccatccagactgaagaccgagtctggtccattgctatcagcccattactcagctcttttgtgacagggacggcttgttgcgggcacttctcacccctgagaatctgggacctcaacagtgggcagctgatgacacacttgggcagtgactttcccccaggggctggggtgctggatgtcatgtatgagtcccctttcacactgctgtcctgtggctatgacacctatgttcgctactgggacctccgcaccagcgtccggaaatgtgtcatggagtgggaggagccccacgacagcaccctgtactgcctgcagacagatggcaaccacctgctggccacaggttcctcctactacggtgttgtacggctgtgggaccggcgtcaaagggcctgcctgcacgccttcccgctgacgtcgactcccctcagcagccctgtgtactgcctgcgtctcaccaccaagcatctctatgctgccctgtcttacaacctccacgtcctggattttcaaaacccatgaccgtcagggccacccctgcctctgggccagggaaaccagctactcagggacttctcttgcctggagggtgcagtgatagctcctcctcactgccccactgtgctcctgggcctgtgaccccagtgctcaggcaccttgcactagaggcttctgactcctgggactttggagcttaccagagatgcagtccctcccaggaacctgttggagaggcaggacctgctgctttagagtgcggctgaacccgggccttgcgtccctgtttggccagagcaaggatctggcctggagaggcccatcctataccccttattagagccatgacagcctacagagtgaggtgaggtgctcccaccttcccagatggttcctttctgccccttcctggaaggaaaggtgaggctgccaatagcctcctggcaccagccagacctcacccttgaccaacctctcggggctgggggttcattcctggggcactgtggcctggttttgctttgaaaccaagaaagagcaaagggaacccagcagttctgagtgagttctgagccagccctacctcaggctggctgttgagacatgctacaattttcatttttgtaaaaataaagcttgattgttcacaaaaaaaa

SEQ ID NO: 454474 - DNA, 1889 bp, Homo sapiens
tttcccaatctggacatccagtggttccaggattgtcatgcattctccattagattgctttggcatcactgtgaacatttttgatagtttaaaggacaggcttttctccttggctttcttagtcaagtatggagagagaacagttactccttcctggtctcctaatctctttacttgtattctggatgctcctgaatcctgactcagtaagcccatgaaattttctgtggttggcaataagttgtagtgattggattatctgttctgtctggacataggatgaccagtgtcccagtgaaggaacgagtgaaggtgtctcagaactggagactggggcgctgccgagaggggattctgctgaagtggagatgcagtcagatgccctggatgcagctagaggatgattctctgtacatatcccaggctaatttcatcctggcctaccagttccgtccagatggtgccagcttgaatcgtcggcctctgggagtctttgctgggcatgatgaggacgtttgccactttgtgctggccaactcgcatattgttagtgcaggaggggatgggaagattggcattcataagattcacagcaccttcactgtcaagtactcggctcatgaacaggaggtgaactgtgtggattgcaaagggggcatcattgtgagtggctccagggacaggacggccaaggtgtggcctttggcctcaggccggctggggcagtgcttacacaccatccagactgaagaccgagtctggtccattgctatcagcccattactcagctcttttgtgacagggacggcttgttgcgggcacttctcacccctgagaatctgggacctcaacagtgggcagctgatgacacacttgggcagtgactttcccccaggggctggggtgctggatgtcatgtatgagtcccctttcacactgctgtcctgtggctatgacacctatgttcgctactgggacctccgcaccagcgtccggaaatgtgtcatggagtgggaggagccccacgacagcaccctgtactgcctgcagacagatggcaaccacctgctggccacaggttcctcctactacggtgttgtacggctgtgggaccggcgtcaaagggcctgcctgcacgccttcccgctgacgtcgactcccctcagcagccctgtgtactgcctgcgtctcaccaccaagcatctctatgctgccctgtcttacaacctccacgtcctggattttcaaaacccatgaccgtcagggccacccctgcctctgggccagggaaaccagctactcagggacttctcttgcctggagggtgcagtgatagctcctcctcactgccccactgtgctcctgggcctgtgaccccagtgctcaggcaccttgcactagaggcttctgactcctgggactttggagcttaccagagatgcagtccctcccaggaacctgttggagaggcaggacctgctgctttagagtgcggctgaacccgggccttgcgtccctgtttggccagagcaaggatctggcctggagaggcccatcctataccccttattagagccatgacagcctacagagtgaggtgaggtgctcccaccttcccagatggttcctttctgccccttcctggaaggaaaggtgaggctgccaatagcctcctggcaccagccagacctcacccttgaccaacctctcggggctgggggttcattcctggggcactgtggcctggttttgctttgaaaccaagaaagagcaaagggaacccagcagttctgagtgagttctgagccagccctacctcaggctggctgttgagacatgctacaattttcatttttgtaaaaataaagcttgattgttcacaaaaaaaa

SEQ ID NO: 454475 - DNA, 2296 bp, Homo sapiens
  misc_feature (2192)..(2192): n is a, c, g, or t
  misc_feature (2202)..(2203): n is a, c, g, or t
  misc_feature (2218)..(2218): n is a, c, g, or t
gtaatcaatataaaattattaatgagatattttgcattcttttttttgtatggcttcaaaatctggtgtgcatttctcacttatagctcatttcaatttgtattagccacatttcaaatgctcagcagccacatgtgacgagggaggacactgttggacagcacaggtctagacctcagtagctctcccttcagattaatgccatgtgaatcgaatgggtggtatgaagaatggatgctgagtccttggagaatccacttgcacttgggtggtgactgataagaagccctagctgtgccatttcctgatacatgactgtttttgaagttatggactcaggatctagaagactgcaaatccccaaatacgtctaacacccaagctcacgccaggaccgtgcttccgggcctgtgtgagaacctaagctatggaacctgtcaacttctagggctgcagattcgttgggccctcacatgtggcccgtggaaaggaggcatcactcgaggaagaggagggcttctagaggggcaaggccacccaactaggggcttcttgagggcaggtgctccaaatggccgcttcctgagggcagcgggtcctcttgtggcctcaggcagggccctgaaaccggcctcacgtgtttgcagcgcgaactcctgtgcttccaccaagcgctctcggggatgcgggggtggtgtcagcgccccggccccagcccgcaccccgaagtggctccaaggctgcaggtgtgaggggcgtgcccagggctcggcccgcgccgccccatgtgacccggtccgacatggtgtcgcctcctcccggggcggcggcggtggcggctcgggctgggctccgcgtcgggccggccccgcggccgctcatgggcagccagggccgctcggggccccccgggaacggcgggcccggcgagggcgagggcggagaggcgaggaagctgcaggaagggagggtggcgagggggaagcgaaggaaggggaaggggaagggaaaagcgagagcggggcaaggcggaagaggaagcggggcggaagggaagcccgggccgcagacggcgaaggaggcagccgggccgggggctgacgcgggagcgagggcatgcccaagggaggaagcagagggaggcagaagcgtggaggaaggggcgagaggcatcgtcaagggagtcgaggggagcgcaggggccgggaaggaggcacaaggaagagagtatgggaagaaggaggaatggagggtcagggctaggcggcgggagggcgccaggccgggaagagcacagggacgagggggtcaggcttgggccgacatcgcggggacaggggtggccatggcggcggcggccggggaggaggaggaggaggaggaggcggctcgggagtcggctgcccgcccggccgcggggcctgcgctctggcgcctgccggaggagctgctgctgctcatctgctcctacctggacatgcgggccctcggccgcctggcccaggtgtgccgctggctgcggcgcttcaccagctgcgatctgctctggcgccggatagcccgggcctcgctcaactccggcttcacgcggctcggcaccgacctgatgaccagtgtcccagtgaaggaacgagtgaaggtgtctcagaactggagactggggcgctgccgagaggggattctgctgaagtggagatgcagtcagatgccctggatgcagctagaggatgattctctgtacatatcccaggctaatttcatcctggcctaccagttccgtccagatggtgccagcttgaatcgtcggcctctgggagtctttgctgggcatgatgaggacgtttgccactttgtgctggccaactcgcatattgttagtgcaggaggggatgggaagattggcattcataagattcacagcaccttcactgtcaagtactcggctcatgaacaggaggtgaactgtgtggattgcaaagggggcatcattgtgagtggctccagggacaggacggccaaggtgtggcctttggcctcaggccggctggggcagtgcttacacaccatccagactgaagaccgagtctggtccattgctatcagcccattactcagctcttttgtgacagggacggcttgttgcgggcacttctcacccctgagaatctgggacctcaacagtgggcgctttnacactggcgnnattcccagggcggtntgagtcgtatagccctacacatgcggcgggagaccctatttccgtgcccgcgcgccgagtctcgttgaagccatatac

SEQ ID NO: 454476 - DNA, 2204 bp, Homo sapiens
  misc_feature (2100)..(2100): n is a, c, g, or t
  misc_feature (2110)..(2111): n is a, c, g, or t
  misc_feature (2126)..(2126): n is a, c, g, or t
gtaatcaatataaaattattaatgagatattttgcattcttttttttgtatggcttcaaaatctggtgtgcatttctcacttatagctcatttcaatttgtattagccacatttcaaatgctcagcagccacatgtgacgagggaggacactgttggacagcacaggtctagacctcagtagctctcccttcagattaatgccatgtgaatcgaatgggtggtatgaagaatggatgctgagtccttggagaatccacttgcacttgggtggtgactgataagaagccctagctgtgccatttcctgatacatgactgtttttgaagttatggactcaggatctagaagactgcaaatccccaaatacgtctaacacccaagctcacgccaggaccgtgcttccgggcctgtgtgagaacctaagctatggaacctgtcaacttctagggctgcagattcgttgggccctcacatgtggcccgtggaaaggaggcatcactcgaggaagaggagggcttctagaggggcaaggccacccaactaggggcttcttgagggcaggtgctccaaatggccgcttcctgagggcagcgggtcctcttgtggcctcaggcagggccctgaaaccggcctcacgtgtttgcagcgcgaactcctgtgcttccaccaagcgctctcggggatgcgggggtggtgtcagcgccccggccccagcccgcaccccgaagtggctccaaggctgcaggtgtgaggggcgtgcccagggctcggcccgcgccgccccatgtgacccggtccgacatggtgtcgcctcctcccggggcggcggcggtggcggctcgggctgggctccgcgtcgggccggccccgcggccgctcatgggcagccagggccgctcggggccccccgggaacggcgggcccggcgagggcgagggcggagaggcgaggaagctgcaggaagggagggtggcgagggggaagcgaaggaaggggaaggggaagggaaaagcgagagcggggcaaggcggaagaggaagcggggcggaagggaagcccgggccgcagacggcgaaggaggcagccgggccgggggctgacgcgggagcgagggcatgcccaagggaggaagcagagggaggcagaagcgtggaggaaggggcgagaggcatcgtcaagggagtcgaggggagcgcaggggccgggaaggaggcacaaggaagagagtatgggaagaaggaggaatggagggtcagggctaggcggcgggagggcgccaggccgggaagagcacagggacgagggggtcaggcttgggccgacatcgcggggacaggggtggccatggcggcggcggccggggaggaggaggaggaggaggaggcggctcgggagtcggctgcccgcccggccgcggggcctgcgctctggcgcctgccggaggagctgctgctgctcatctgctcctacctggacatgcgggccctcggccgcctggcccaggtgtgccgctggctgcggcgcttcaccagctgcgatctgctctggcgccggatagcccgggcctcgctcaactccggcttcacgcggctcggcaccgacctgatgaccagtgtcccagtgaaggaacgagtgaaggtgtctcagaactggagactggggcgctgccgagaggggattctgctgaagtggagatgcagtcagatgccctggatgcagctagaggatgattctctgtacatatcccaggctaatttcatcctggcctaccagttccgtccagatggtgccagcttgaatcgtcggcctctgggagtctttgctgggcatgatgaggacgtttgccactttgtgctggccaactcgcatattgttagtgcaggaggggatgggaagattggcattcataagattcacagcaccttcactgtcaagtactcggctcatgaacaggaggtgaactgtgtggattgcaaagggggcatcattgtgagtggctccagggacaggacggccaaggtgctcttttgtgacagggacggcttgttgcgggcacttctcacccctgagaatctgggacctcaacagtgggcgctttnacactggcgnnattcccagggcggtntgagtcgtatagccctacacatgcggcgggagaccctatttccgtgcccgcgcgccgagtctcgttgaagccatatac

SEQ ID NO: 454477 - DNA, 710 bp, Homo sapiens
cacgaggcttaccatcaatatgattttatgggtttttttctttattcatctgttcagtacacatttgagagaaggcttcagagaggagttgataattgatgatgtcttacaggataagtcaaattctactgggttgacaaggtagagtttactttagaagagattgcagatgtggaaggacttggtacatccttcggggagaatgtactactcatcacctcccacctgtgaaagcccctcttcagacaaagaagaaaacaacaaatcattgttttctttgtggaaagaaaacaggactggctagtagctacgaatgcaggcaggttggcgagctggagaagctcagatgctttctctgtgataacccagcttggggattatgcaaaataaaatatttaaattgcctgtttataacatcattaagatgatgttcaatagctatcttcagttgaacttctaattggctgaagtaaagaacaagtagatagctcatgggtttccaaaagacaaaaacagatccttccttgtcctttaagttaggaggtttaaaccaatctgagagtgtacctttttcgtcttatgatgaacctgcttggattttgtttgagtggcaccttggaagaacccctccctgaatattctattaaaaatttaattaaaaaattaaaagttaatataaaatagatgaataatatatttccaaaaaagta

SEQ ID NO: 454478 - DNA, 1268 bp, Homo sapiens
cacgaggcttaccatcaatatgattttatgggtttttttctttattcatctgttcagtacacatttgagagaaggcttcagagaggagttgataattgatgatgtcttacaggataagtcaaattctactgggttgacaaggtagagtttactttagaagagattgcagatgtggaaggacttggtacatccttcggggtaggtatgacatggtaaattacagtgtctctggatagttagaaaggcattatattggacataataataccttaaatgccagtccaaggaatttagatttttcctgtttatagtggggaatcaatatgtttattgatggttcctagtacacagtagttgctaatagttttctctattggtagaaggatgtatggaggctgctctcatagagtactgcacttatatttttgtgctacctcattactgtcactaatgtattctctgtctctacacattcgcaagagttctttttttttagacagagtctcgccctgttacctgattaggctgaagtgcagtggcacgatctcggctcactgcaacctcttcctcgcgggttgaagtgattcttctgcttcagcctcctgagtagctgggactacaggcgcgtgctaccatgcccagctaatttatgtatttttagtagagacggagttttaccatgttggcctgactggtcttgaactgacctcagttgattcgcccaccttggcctcccaaagtgctaggattacagatgtgagccaccgcgcccagcctcacaagagttcttaaatgaaaaaaagtatggagaatatcaagttaagcatcccctaagaaaagaaaaaaaatgaaaatgtgactacagtgaattaaattatcatcagagattcttccaccattgtttaaggaagaatatcctaagcctgaattttaaagatggtttcgagtagattaacattcattggacatcttgtaatatatgcctttctttggtgtcttgtgcaagtgcaagtaaatatctttttaaaaatactttaaataatggaattactccctcacctttgtgagatgttcttggtatctctaagtgcacttgagaaagaaaacgtttattaactgagttggtacccaggcaccattaggagtctctcaattgtttcaaattttgtttctagttttggcaagatctggaagtgtattttatactggtaataaagaagatttaattttgctgggcttgtgtacaaattacctaatctctgttgtga

SEQ ID NO: 454479 - DNA, 393 bp, Homo sapiens
taaaaaaattctgattcatggaaatctcatcagcctgttgtctgggttgcacaattatcagccttggctgataaaatgaaatcagacattctcatggaaatggattttgcctctttgggaatgatatggcagtggtggttctatgtataattcagatacagatgaggatgaagaaactgagccttcttcttctgggcaacagataattgaaaattcaataactatgaataagatgaagctgctgaaggctaagatgaagaacatgaatctcagcaaaaaggtgaagctgttggcatttgaccaggcttatctctagcttacccctgcagagcactcagcaatgaggtctgttggtcattgtgaaaaaattataaagtattattcattaaaaaa

SEQ ID NO: 454480 - DNA, 620 bp, Homo sapiens
aaggcattctgttccattcttgccttgtggaagcagcagaatgaacctaggtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaaggtattcccatctgtcgacaacacttaatttggaataacatggaacttgaaaatgattattgcttgaatgattacaacatttcagaagggtgtaccttgaagctagttttggctatgcgtggcggacctataaatactagaagagatcttcaaatcccaagatgatgatcgttttgcaaaattccaacattgcctgtttacctggtttgtgatgtgtctgggtttcatggatattatcatggccccggttgcatcctttctcagaatata

SEQ ID NO: 454481 - DNA, 5056 bp, Homo sapiens
cgggcgggaggcggccgcgagccgggccggccgcgcgcaagtccggcgccagccgctagagcccccagtgcgcggcccggccgcggggcgcctcgacccgacacaataaactccgagggcgggcgggccgaggggccggtggggccgagcggccgccccgcgcgcatcgccatgtgagcggctgccgcggcttcgcggggacccaactttcccgggcggcggcgcccaacttcccgccgcccgctccggccccgtaggcccgcggcgccaggggaagacgcgagtaagtgcgggcggcggtgccctcccggccctcaccccgcacgcggcgacctcggccgcctagctctcccttcgctcaggcgcgaccgcggcgttctctgagctaaagaagtaaacaggtcatggcacgtttaacaaaaagacgacaggcggatacaaaagctatccagcatctttgggcagccattgagattatacggaaccagaagcagattgccaacattgaccgtattacaaaatgtgaaacaactacattattcttgaacctatggtgatttttacatcattacacagatatgtcattttcattagttgtatcattgttataaactggtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaggaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagccaaaaactacctttatccatatgtgaaattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaatgtctggattaagaagcattaccaataggaatggatcgatagttgaataatgattttttatacatagatatataaaatacagccaggaaaacttaaattacttttcttttaaaatatctcacaatttatgtggtatttttaaagactgatcttagaccaagtcaaattcccatttatcatttagttattttttgaggttagagaataatttgtacatatttatttagacctttgatatttattaaagcaattactcacaatggaagtgaaagaatcaggagaaaagccttttaaaaagtattctccaggtttgtcagggtcactctaaagataaaaatgtaactaagtcttctgtgaaatatcatccatctaatcttgatgctgttgcagatggtggtgacacaagttaattgacaaactactgccaaatggtgcacaatattttgtaaaaagtacccagtagccccatttcatacaatgtacctaaattatgcagtaacttggcatcatcgttccctccttgttgctgtgtaattagtcagtgttgccacagtgtgtggcgctgatggagatgtcagaaccgagaacacttaaccttctttgattgtttttcaagttttaagacttcgatccacccctatgagagcaagtaattgtggaaatatttttggtgtaaaatcattccagagtatgtaatatttaactgatagctgcatgaaagtgagattcgtgttactttggcttttctgtctctgttgacacggttgcacatttccaagttactacagcgtgaaaactgtgtgtttaaaaaaaaacaaaattaaaaaaagagattgtggcctggttttgtaaaagttttaggtaaaattacaattgattgttttaggaatcattattaaaaattttctgcaaatcataaagctatatcgaggtgttgagcttagccactatgcacattgtaattattcattgtggctgtccagttctatgatgcattctggcattttgtaagctgctctgactagcaatatatagattcatttaatgtgttaacattggttaataaatgtatttaaaaaaaactaaaaaaaaaaaaacaaacaacaaaaacacacaaccaacaacaacaaaaaaaacacaaaccaacaaaaaaaacacacacacacaacaaacaacacaaaaaaaagaagcgggggcggcgcgcccgcccaaaaaaaaccccccggcggggggagccccacacctccccccccccacctttttaacaaaggacgcgccccccacaggggcgcccaaaaacaccgaagcgacggcgcgcgcaaacccacccgtgggccgagagaccaaacgccctgtcggcatctcttgggagagcacaccctccctccgcggggcgaaaacagaggcggaaccccagccaacacagaaaattacgcggcgcggcaacaaacactgccgcgctatggggtcaccccggcaattctgcgctgaacaaactggcggataattataaaattagggggcagtgataacaaccccagacgatgcggcagtcactgcgaccacacgctctagcatacctcctaagacaggccgctgagaccgcgtgtgccgagcgcacgcgacccaaccaagagatcgcggaagccctcgcaggacatccagc

SEQ ID NO: 454482 - DNA, 4766 bp, Homo sapiens
ccggggctgagctgcggcggcgcctgacaatgccccctcgcgccccggcctcggcgcccgctcccggctccagcgcgcctgcacgtacgtagccttcacgtgtgtgtggatacggagtgcatgtgtggagacagaggaatatgctccaacaaatttcggatagaggcgccgaagacaggacgtggggaagctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaggaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagccaaaaactacctttatccatatgtgaaattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaatgtctggattaagaagcattaccaataggaatggatcgatagttgaataatgattttttatacatagatatataaaatacagccaggaaaacttaaattacttttcttttaaaatatctcacaatttatgtggtatttttaaagactgatcttagaccaagtcaaattcccatttatcatttagttattttttgaggttagagaataatttgtacatatttatttagacctttgatatttattaaagcaattactcacaatggaagtgaaagaatcaggagaaaagccttttaaaaagtattctccaggtttgtcagggtcactctaaagataaaaatgtaactaagtcttctgtgaaatatcatccatctaatcttgatgctgttgcagatggtggtgacacaagttaattgacaaactactgccaaatggtgcacaatattttgtaaaaagtacccagtagccccatttcatacaatgtacctaaattatgcagtaacttggcatcatcgttccctccttgttgctgtgtaattagtcagtgttgccacagtgtgtggcgctgatggagatgtcagaaccgagaacacttaaccttctttgattgtttttcaagttttaagacttcgatccacccctatgagagcaagtaattgtggaaatatttttggtgtaaaatcattccagagtatgtaatatttaactgatagctgcatgaaagtgagattcgtgttactttggcttttctgtctctgttgacacggttgcacatttccaagttactacagcgtgaaaactgtgtgtttaaaaaaaaacaaaattaaaaaaagagattgtggcctggttttgtaaaagttttaggtaaaattacaattgattgttttaggaatcattattaaaaattttctgcaaatcataaagctatatcgaggtgttgagcttagccactatgcacattgtaattattcattgtggctgtccagttctatgatgcattctggcattttgtaagctgctctgactagcaatatatagattcatttaatgtgttaacattggttaataaatgtatttaaaaaaaactaaaaaaaaaaaaacaaacaacaaaaacacacaaccaacaacaacaaaaaaaacacaaaccaacaaaaaaaacacacacacacaacaaacaacacaaaaaaaagaagcgggggcggcgcgcccgcccaaaaaaaaccccccggcggggggagccccacacctccccccccccacctttttaacaaaggacgcgccccccacaggggcgcccaaaaacaccgaagcgacggcgcgcgcaaacccacccgtgggccgagagaccaaacgccctgtcggcatctcttgggagagcacaccctccctccgcggggcgaaaacagaggcggaaccccagccaacacagaaaattacgcggcgcggcaacaaacactgccgcgctatggggtcaccccggcaattctgcgctgaacaaactggcggataattataaaattagggggcagtgataacaaccccagacgatgcggcagtcactgcgaccacacgctctagcatacctcctaagacaggccgctgagaccgcgtgtgccgagcgcacgcgacccaaccaagagatcgcggaagccctcgcaggacatccagc

SEQ ID NO: 454483 - DNA, 4441 bp, Homo sapiens
aaaattatttataaaccaattcctagccccaattcagaactataaatatatcttagtagttatggtaaactgtcacagaggctaacagttctgttttcaatctcgatcctcctgtgttgtaaagaatgacaggtgtgtgcttagggtctcaccgcccacactggcccaagcattcgtgcactaccaagcttagcagcagctttctacattattgtcaaatgagatgttcaagccattaaagttcactctgataaattaatgtagtgtctttgtggctgcgggatatctgacctgccatgcttcattatactatattattaaaaccgcaggtggcgttgttggcttcttttacacacattctctgtcaatactgtgggatggcagtagtcatcctgatgtcatcctagaaaagactgcttgtcctgtgaacttagtccagacaagtatttttactggtaactcttttcgtcattctgttttttgccctctgcagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaggaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagccaaaaactacctttatccatatgtgaaattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaatgtctggattaagaagcattaccaataggaatggatcgatagttgaataatgattttttatacatagatatataaaatacagccaggaaaacttaaattacttttcttttaaaatatctcacaatttatgtggtatttttaaagactgatcttagaccaagtcaaattcccatttatcatttagttattttttgaggttagagaataatttgtacatatttatttagacctttgatatttattaaagcaattactcacaatggaagtgaaagaatcaggagaaaagccttttaaaaagtattctccaggtttgtcagggtcactctaaagataaaaatgtaactaagtcttctgtgaaatatcatccatctaatcttgatgctgttgcagatggtggtgacacaagttaattgacaaactactgccaaatggtgcacaatattttgtaaaaagtacccagtagccccatttcatacaatgtacctaaattatgcagtaacttggcatcatcgttccctccttgttgctgtgtaattagtcagtgttgccacagtgtgtggcgctgatggagatgtcagaaccgagaacacttaaccttctttgattgtttttcaagttttaagacttcgatccacccctatgagagcaagtaattgtggaaatatttttggtgtaaaatcattccagagtatgtaatatttaactgatagctgcatgaaagtgagattcgtgttactttggcttttctgtctctgttgacacggttgcacatttccaagttactacagcgtgaaaactgtgtgtttaaaaaaaaacaaaattaaaaaaagagattgtggcctggttttgtaaaagttttaggtaaaattacaattgattgttttaggaatcattattaaaaattttctgcaaatcataaagctatatcgaggtgttgagcttagccactatgcacattgtaattattcattgtggctgtccagttctatgatgcattctggcattttgtaagctgctctgactagcaatatatagattcatttaatgtgttaacattggttaataaatgtatttaaaaaaaactaaaaaaaaaaaaacaaacaacaaaaacacacaaccaacaacaacaaaaaaaacacaaaccaacaaaaaaaacacacacacacaacaaacaacacaaaaaaaagaagcgggggcggcgcgcccgcccaaaaaaaaccccccggcggggggagccccacacctccccccccccacctttttaacaaaggacgcgccccccacaggggcgcccaaaaacaccgaagcgacggcgcgcgcaaacccacccgtgggccgagagaccaaacgccctgtcggcatctcttgggagagcacaccctccctccgcggggcgaaaacagaggcggaaccccagccaacacagaaaattacgcggcgcggcaacaaacactgccgcgctatggggtcaccccggcaattctgcgctgaacaaactggcggataattataaaattagggggcagtgataacaaccccagacgatgcggcagtcactgcgaccacacgctctagcatacctcctaagacaggccgctgagaccgcgtgtgccgagcgcacgcgacccaaccaagagatcgcggaagccctcgcaggacatccagc

SEQ ID NO: 454484 - DNA, 3725 bp, Homo sapiens
attggtaggtggtgtcacaaaggggcggggcgcggcggcagcggagcgttgtcggccagtgccttccgtgaagttgctcgccgggtcgttgggccctgtcgacctgtaggcgggcgagcgagccagcggacaagactgcgggtgaggctgagctagcgagcggccggcagggggggcgcccgggctgcgagccgctgagcccagccgcgctgccgccgccggccgtcgtggggccggaatggcgcaaggccggagtggcgcgggcgctcggcgctgggctgccgggtagagtcctgtccccgcccctcgccttgcggcctgacgccggccgctgctgcccggggaccggagcggcgggccgcctttgcccaggacacacgctctggcgtttgttcctttgggcgtgacgccagcttcaacgggtacgcggctttcccgacgggtgctgatctccgagtcgctgttgtcacgcggactgctgtcctccagattcaggccggtgggtctggggagcccggattggtcttggaggagcaacggctgcgcaggtgactcggtggcctcaagtgtgtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaaggtattcccatctgtcgacaacacttaatttggaataacatggaacttgaaaatgattattgcttgaatgattacaacatttcagaagggtgtaccttgaagctagttttggctatgcgtggcggacctataaatactagaagagttcctacagacgatccacttaggaagatggcagagtacttggattccagtcgagttgaggtctgggagaagacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgagtggtggttctatgtataattcagatacagatgaggatgaagaaactgagccttcttcttctgggcaacagataattgaaaattcaataactatgaataagatgaagctgctgaaggctaagatgaagaacatgaatctcagcaaaaagcctaagaaagctgtcaagataaaacctcacccacctgtagctcctcgaccttctagtggttccactgcaccatctcgccaccgattgttaagggtcctccccaacattggtcaatcttgttcacctgcttttgggaatgcatatccgcccgaaatctccaggaatggaatttcaagtttggcaactcaactctctgctgagagatacatatcttctatcactggtgaatttcttaaggaagataatagctgggagaataacacactgtctcacttcagtagcaacgtcaaactacctcctcagataccccatttggagttgggaaatgaccaggagcttgctgactctgttctccatcttggatcatccctgcctaggcaaacaaaacattttttaggaaacttgccatctagtaatgggaacattgtcttaccttcagaagaatgtgtaaccgaacaatcacttctacctaaagtgggctcactggcttcatttgcagaaggaaatgctgatgaacagagcagcggcttagaaggtgcgtgcaaagtgaatctggagttgctactcactaatgctgacaaagggttgaaagctccagagcagcatctcaagcatgttgcaggagtgctgaatggggaatcagtagagacttcagttcttaactaccgggaattaagtcctcacaagaatagactcttgtcacctcttcgctgttctgcaccaatgtcgctacataattctctggtgaaaccagagagacagtccaaatgttttgagtttgggaagctacagccttcttcttctcagtcactggatgttcaaaacataactgattcttctttctctaggactacttgctttcaaggtgttaaagttgattcacttgggaaaagatctgatgttatttccaaagttgaggctcgggatatcacagaaatgactaacaaggcttccaaagagcctgttggttgtgtaaataatatcagttttcttgcctcactggccgggagcacaagcagaaatagattacagagcacacgtggggcaggcaggcttcagaactctggaactgggctgtctacaaacctccagcattttcaggaagaaaactttaggaaaagttctccccagttagaacatacaggagtttttttgtctacccatggtgttggaatgaatggaaataatgcagcagcagggaaaagcgtaggagaatgtactactcatcacctcccacctgtgaaagcccctcttcagacaaagaagaaaacaacaaatcattgttttctttgtggaaagaaaacaggactggctagtagctacgaatgcagatgtggaaacaacttctgtgcatctcatcgttatgcagaaactcatggctgtacctatgattacaagagtgcagggaggagatacttgcacgaggcaaatcctgtggttaatgcaccaaagcttccaaaaatctaactcttcctctacatcttactgttctgcccgggattcgtattataatgacagaagaaatgttgtttagactattatttttgttcgactctaaaagatttgccaaataacaaaagcatacaatgcatactgttggagaacaagaatgctactgtattttacatctttatttcttggtgaaacaaaagttttaaaagtagttttaacaactttacactggaatgatttagctttgttattgcatgtcttgtgttaagtgttttgtatatgatattgcagttttactaggcaaatcttcaaaagatgcactttaggaaacgaaatatttcctaaataaccaggcttccacattgtacagaatgagcagtcatgtaatgaatggctctactcagattgaccatatgggttttttctttttctttcttttattcttctccttctttttttttcagaggtgggatgggtggagattttttaaaaatcccacgtgtgaaagtttactggctttattagcaagttcctttttacttcaagctactttttataaaaaagaacatttttccagtgtggtttttaacagataatacatttcttccacattcagattagtattcggacatgaatccattctataaaacacatcgtgttcatgatagtgtatattttactactttttgaatgttaattttaaaatagaagatgtcccacttgccattaaatatagaagccaactttttaccttttgaaatatggctacatttaaaacaaaatctcacagctcggtttttcttatttgttgagtgctattaccaggagaaattcaaataaatattcaatttcattatgaaaaaaaaaat

SEQ ID NO: 454485 - DNA, 3056 bp, Homo sapiens
  misc_feature (3026)..(3026): n is a, c, g, or t
  misc_feature (3034)..(3034): n is a, c, g, or t
cgggcgggaggcggccgcgagccgggccggccgcgcgcaagtccggcgccagccgctagagcccccagtgcgcggcccggccgcggggcgcctcgacccgacacaataaactccgagggcgggcgggccgaggggccggtggggccgagcggccgccccgcgcgcatcgccatgtgagcggctgccgcggcttcgcggggacccaactttcccgggcggcggcgcccaacttcccgccgcccgctccggccccgtaggcccgcggcgccaggggaagacgcgagtaagtgcgggcggcggtgccctcccggccctcaccccgcacgcggcgacctcggccgcctagctctcccttcgctcaggcgcgaccgcggcgttctctgagctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaggaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagggcccaaaacctacccccttatccccttnggtgggantttagggtgagggggctacggg

SEQ ID NO: 454486 - DNA, 3703 bp, Homo sapiens
attggtaggtggtgtcacaaaggggcggggcgcggcggcagcggagcgttgtcggccagtgccttccgtgaagttgctcgccgggtcgttgggccctgtcgacctgtaggcgggcgagcgagccagcggacaagactgcgggtgaggctgagctagcgagcggccggcagggggggcgcccgggctgcgagccgctgagcccagccgcgctgccgccgccggccgtcgtggggccggaatggcgcaaggccggagtggcgcgggcgctcggcgctgggctgccgggtagagtcctgtccccgcccctcgccttgcggcctgacgccggccgctgctgcccggggaccggagcggcgggccgcctttgcccaggacacacgctctggcgtttgttcctttgggcgtgacgccagcttcaacgggtacgcggctttcccgacgggtgctgatctccgagtcgctgttgtcacgcggactgctgtcctccagattcaggccggtgggtctggggagcccggattggtcttggaggagcaacggctgcgcaggtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaaggtattcccatctgtcgacaacacttaatttggaataacatggaacttgaaaatgattattgcttgaatgattacaacatttcagaagggtgtaccttgaagctagttttggctatgcgtggcggacctataaatactagaagagttcctacagacgatccacttaggaagatggcagagtacttggattccagtcgagttgaggtctgggagaagacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgagtggtggttctatgtataattcagatacagatgaggatgaagaaactgagccttcttcttctgggcaacagataattgaaaattcaataactatgaataagatgaagctgctgaaggctaagatgaagaacatgaatctcagcaaaaagcctaagaaagctgtcaagataaaacctcacccacctgtagctcctcgaccttctagtggttccactgcaccatctcgccaccgattgttaagggtcctccccaacattggtcaatcttgttcacctgcttttgggaatgcatatccgcccgaaatctccaggaatggaatttcaagtttggcaactcaactctctgctgagagatacatatcttctatcactggtgaatttcttaaggaagataatagctgggagaataacacactgtctcacttcagtagcaacgtcaaactacctcctcagataccccatttggagttgggaaatgaccaggagcttgctgactctgttctccatcttggatcatccctgcctaggcaaacaaaacattttttaggaaacttgccatctagtaatgggaacattgtcttaccttcagaagaatgtgtaaccgaacaatcacttctacctaaagtgggctcactggcttcatttgcagaaggaaatgctgatgaacagagcagcggcttagaaggtgcgtgcaaagtgaatctggagttgctactcactaatgctgacaaagggttgaaagctccagagcagcatctcaagcatgttgcaggagtgctgaatggggaatcagtagagacttcagttcttaactaccgggaattaagtcctcacaagaatagactcttgtcacctcttcgctgttctgcaccaatgtcgctacataattctctggtgaaaccagagagacagtccaaatgttttgagtttgggaagctacagccttcttcttctcagtcactggatgttcaaaacataactgattcttctttctctaggactacttgctttcaaggtgttaaagttgattcacttgggaaaagatctgatgttatttccaaagttgaggctcgggatatcacagaaatgactaacaaggcttccaaagagcctgttggttgtgtaaataatatcagttttcttgcctcactggccgggagcacaagcagaaatagattacagagcacacgtggggcaggcaggcttcagaactctggaactgggctgtctacaaacctccagcattttcaggaagaaaactttaggaaaagttctccccagttagaacatacaggagtttttttgtctacccatggtgttggaatgaatggaaataatgcagcagcagggaaaagcgtaggagaatgtactactcatcacctcccacctgtgaaagcccctcttcagacaaagaagaaaacaacaaatcattgttttctttgtggaaagaaaacaggactggctagtagctacgaatgcagatgtggaaacaacttctgtgcatctcatcgttatgcagaaactcatggctgtacctatgattacaagagtgcagggaggagatacttgcacgaggcaaatcctgtggttaatgcaccaaagcttccaaaaatctaactcttcctctacatcttactgttctgcccgggattcgtattataatgacagaagaaatgttgtttagactattatttttgttcgactctaaaagatttgccaaataacaaaagcatacaatgcatactgttggagaacaagaatgctactgtattttacatctttatttcttggtgaaacaaaagttttaaaagtagttttaacaactttacactggaatgatttagctttgttattgcatgtcttgtgttaagtgttttgtatatgatattgcagttttactaggcaaatcttcaaaagatgcactttaggaaacgaaatatttcctaaataaccaggcttccacattgtacagaatgagcagtcatgtaatgaatggctctactcagattgaccatatgggttttttctttttctttcttttattcttctccttctttttttttcagaggtgggatgggtggagattttttaaaaatcccacgtgtgaaagtttactggctttattagcaagttcctttttacttcaagctactttttataaaaaagaacatttttccagtgtggtttttaacagataatacatttcttccacattcagattagtattcggacatgaatccattctataaaacacatcgtgttcatgatagtgtatattttactactttttgaatgttaattttaaaatagaagatgtcccacttgccattaaatatagaagccaactttttaccttttgaaatatggctacatttaaaacaaaatctcacagctcggtttttcttatttgttgagtgctattaccaggagaaattcaaataaatattcaatttcattatgaaaaaaaaaat

SEQ ID NO: 454487 - DNA, 3581 bp, Homo sapiens
attggtaggtggtgtcacaaaggggcggggcgcggcggcagcggagcgttgtcggccagtgccttccgtgaagttgctcgccgggtcgttgggccctgtcgacctgtaggcgggcgagcgagccagcggacaagactgcgggtgaggctgagctagcgagcggccggcagggggggcgcccgggctgcgagccgctgagcccagccgcgctgccgccgccggccgtcgtggggccggaatggcgcaaggccggagtggcgcgggcgctcggcgctgggctgccgggtagagtcctgtccccgcccctcgccttgcggcctgacgccggccgctgctgcccggggaccggagcggcgggccgcctttgcccaggacacacgctctggcgtttgttcctttgggcgtgacgccagcttcaacgggtacgcggctttcccgacgggtgctgatctccgagtcgctgttgtcacgcggactgctgtcctccagattcaggccggtgggtctggggagcccggattggtcttggaggagcaacggctgcgcaggtgactcggtggcctcaagtgtgtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaagttcctacagacgatccacttaggaagatggcagagtacttggattccagtcgagttgaggtctgggagaagacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgagtggtggttctatgtataattcagatacagatgaggatgaagaaactgagccttcttcttctgggcaacagataattgaaaattcaataactatgaataagatgaagctgctgaaggctaagatgaagaacatgaatctcagcaaaaagcctaagaaagctgtcaagataaaacctcacccacctgtagctcctcgaccttctagtggttccactgcaccatctcgccaccgattgttaagggtcctccccaacattggtcaatcttgttcacctgcttttgggaatgcatatccgcccgaaatctccaggaatggaatttcaagtttggcaactcaactctctgctgagagatacatatcttctatcactggtgaatttcttaaggaagataatagctgggagaataacacactgtctcacttcagtagcaacgtcaaactacctcctcagataccccatttggagttgggaaatgaccaggagcttgctgactctgttctccatcttggatcatccctgcctaggcaaacaaaacattttttaggaaacttgccatctagtaatgggaacattgtcttaccttcagaagaatgtgtaaccgaacaatcacttctacctaaagtgggctcactggcttcatttgcagaaggaaatgctgatgaacagagcagcggcttagaaggtgcgtgcaaagtgaatctggagttgctactcactaatgctgacaaagggttgaaagctccagagcagcatctcaagcatgttgcaggagtgctgaatggggaatcagtagagacttcagttcttaactaccgggaattaagtcctcacaagaatagactcttgtcacctcttcgctgttctgcaccaatgtcgctacataattctctggtgaaaccagagagacagtccaaatgttttgagtttgggaagctacagccttcttcttctcagtcactggatgttcaaaacataactgattcttctttctctaggactacttgctttcaaggtgttaaagttgattcacttgggaaaagatctgatgttatttccaaagttgaggctcgggatatcacagaaatgactaacaaggcttccaaagagcctgttggttgtgtaaataatatcagttttcttgcctcactggccgggagcacaagcagaaatagattacagagcacacgtggggcaggcaggcttcagaactctggaactgggctgtctacaaacctccagcattttcaggaagaaaactttaggaaaagttctccccagttagaacatacaggagtttttttgtctacccatggtgttggaatgaatggaaataatgcagcagcagggaaaagcgtaggagaatgtactactcatcacctcccacctgtgaaagcccctcttcagacaaagaagaaaacaacaaatcattgttttctttgtggaaagaaaacaggactggctagtagctacgaatgcagatgtggaaacaacttctgtgcatctcatcgttatgcagaaactcatggctgtacctatgattacaagagtgcagggaggagatacttgcacgaggcaaatcctgtggttaatgcaccaaagcttccaaaaatctaactcttcctctacatcttactgttctgcccgggattcgtattataatgacagaagaaatgttgtttagactattatttttgttcgactctaaaagatttgccaaataacaaaagcatacaatgcatactgttggagaacaagaatgctactgtattttacatctttatttcttggtgaaacaaaagttttaaaagtagttttaacaactttacactggaatgatttagctttgttattgcatgtcttgtgttaagtgttttgtatatgatattgcagttttactaggcaaatcttcaaaagatgcactttaggaaacgaaatatttcctaaataaccaggcttccacattgtacagaatgagcagtcatgtaatgaatggctctactcagattgaccatatgggttttttctttttctttcttttattcttctccttctttttttttcagaggtgggatgggtggagattttttaaaaatcccacgtgtgaaagtttactggctttattagcaagttcctttttacttcaagctactttttataaaaaagaacatttttccagtgtggtttttaacagataatacatttcttccacattcagattagtattcggacatgaatccattctataaaacacatcgtgttcatgatagtgtatattttactactttttgaatgttaattttaaaatagaagatgtcccacttgccattaaatatagaagccaactttttaccttttgaaatatggctacatttaaaacaaaatctcacagctcggtttttcttatttgttgagtgctattaccaggagaaattcaaataaatattcaatttcattatgaaaaaaaaaat

SEQ ID NO: 454488 - DNA, 3104 bp, Homo sapiens
attggtaggtggtgtcacaaaggggcggggcgcggcggcagcggagcgttgtcggccagtgccttccgtgaagttgctcgccgggtcgttgggccctgtcgacctgtaggcgggcgagcgagccagcggacaagactgcgggtgaggctgagctagcgagcggccggcagggggggcgcccgggctgcgagccgctgagcccagccgcgctgccgccgccggccgtcgtggggccggaatggcgcaaggccggagtggcgcgggcgctcggcgctgggctgccgggtagagtcctgtccccgcccctcgccttgcggcctgacgccggccgctgctgcccggggaccggagcggcgggccgcctttgcccaggacacacgctctggcgtttgttcctttgggcgtgacgccagcttcaacgggtacgcggctttcccgacgggtgctgatctccgagtcgctgttgtcacgcggactgctgtcctccagattcaggccggtgggtctggggagcccggattggtcttggaggagcaacggctgcgcaggtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaaggtattcccatctgtcgacaacacttaatttggaataacatggaacttgaaaatgattattgcttgaatgattacaacatttcagaagggtgtaccttgaagctagttttggctatgcgtggcggacctataaatactagaagagttcctacagacgatccacttaggaagatggcagagtacttggattccagtcgagttgaggtctgggagaagacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgagtggtggttctatgtataattcagatacagatgaggatgaagaaactgagccttcttcttctgggcaacagataattgaaaattcaataactatgaataagatgaagctgctgaaggctaagatgaagaacatgaatctcagcaaaaagcctaagaaagctgtcaagataaaacctcacccacctgtagctcctcgaccttctagtggttccactgcaccatctcgccaccgattgttaagggtcctccccaacattggtcaatcttgttcacctgcttttgggaatgcatatccgcccgaaatctccaggaatggaatttcaagtttggcaactcaactctctgctgagagatacatatcttctatcactggtgaatttcttaaggaagataatagctgggagaataacacactgtctcacttcagtagcaacgtcaaactacctcctcagataccccatttggagttgggaaatgaccaggagcttgctgactctgttctccatcttggatcatccctgcctaggcaaacaaaacattttttaggaaacttgccatctagtaatgggaacattgtcttaccttcagaagaatgtgtaaccgaacaatcacttctacctaaagtgggctcactggcttcatttgcagaaggaaatgctgatgaacagagcagcggcttagaaggtgcgtgcaaagtgaatctggagttgctactcactaatgctgacaaagggttgaaagctccagagcagcatctcaagcatgttgcaggagtgctgaatggggaatcagtagagacttcagttcttaactaccgggaattaagtcctcacaagaatagactcttgtcacctcttcgctgttctgcaccaatgtcgctacataattctctggtgaaaccagagagacagtccaaatgttttgagtttgggaagctacagccttcttcttctcagtcactggatgttcaaaacataactgattcttctttctctaggactacttgctttcaaggtgttaaagttgattcacttgggaaaagatctgatgttatttccaaagttgaggctcgggatatcacagaaatgactaacaaggcttccaaagagcctgttggttgtgtaaataatatcagttttcttgcctcactggccgggagcacaagcagaaatagattacagagcacacgtggggcaggcaggcttcagaactctggaactgggctgtctacaaacctccagcattttcaggaagaaaactttaggaaaagttctccccagttagaacatacaggagtttttttgtctacccatggtgttggaatgaatggaaataatgcagcagcagggaaaagcgtaggagaatgtactactcatcacctcccacctgtgaaagcccctcttcagacaaagaagaaaacaacaaatcattgttttctttgtggaaagaaaacaggactggctagtagctacgaatgcaggcaggttggcgagctggagaagctcagatgctttctctgtgataacccagcttggggattatgcaaaataaaatatttaaattgcctgtttataacatcattaagatgatgttcaatagctatcttcagttgaacttctaattggctgaagtaaagaacaagtagatagctcatgggtttccaaaagacaaaaacagatccttccttgtcctttaagttaggaggtttaaaccaatctgagagtgtacctttttcgtcttatgatgaacctgcttggattttgtttgagtggcaccttggaagaacccctccctgaatattctattaaaaatttaattaaaaaattaaaagttaatataaaatagatgaataatatatttccaaaaaagta

SEQ ID NO: 454489 - DNA, 1894 bp, Homo sapiens
attggtaggtggtgtcacaaaggggcggggcgcggcggcagcggagcgttgtcggccagtgccttccgtgaagttgctcgccgggtcgttgggccctgtcgacctgtaggcgggcgagcgagccagcggacaagactgcgggtgaggctgagctagcgagcggccggcagggggggcgcccgggctgcgagccgctgagcccagccgcgctgccgccgccggccgtcgtggggccggaatggcgcaaggccggagtggcgcgggcgctcggcgctgggctgccgggtagagtcctgtccccgcccctcgccttgcggcctgacgccggccgctgctgcccggggaccggagcggcgggccgcctttgcccaggacacacgctctggcgtttgttcctttgggcgtgacgccagcttcaacgggtacgcggctttcccgacgggtgctgatctccgagtcgctgttgtcacgcggactgctgtcctccagattcaggccggtgggtctggggagcccggattggtcttggaggagcaacggctgcgcaggtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaaggtattcccatctgtcgacaacacttaatttggaataacatggaacttgaaaatgattattgcttgaatgattacaacatttcagaagggtgtaccttgaagctagttttggctatgcgtggcggacctataaatactagaagagttcctacagacgatccacttaggaagatggcagagtacttggattccagtcgagttgaggtctgggagaagacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgagtggtggttctatgtataattcagatacagatgaggatgaagaaactgagccttcttcttctgggcaacagataattgaaaattcaataactatgaataagatgaagctgctgaaggctaagatgaagaacatgaatctcagcaaaaaggagaatgtactactcatcacctcccacctgtgaaagcccctcttcagacaaagaagaaaacaacaaatcattgttttctttgtggaaagaaaacaggactggctagtagctacgaatgcaggcaggttggcgagctggagaagctcagatgctttctctgtgataacccagcttggggattatgcaaaataaaatatttaaattgcctgtttataacatcattaagatgatgttcaatagctatcttcagttgaacttctaattggctgaagtaaagaacaagtagatagctcatgggtttccaaaagacaaaaacagatccttccttgtcctttaagttaggaggtttaaaccaatctgagagtgtacctttttcgtcttatgatgaacctgcttggattttgtttgagtggcaccttggaagaacccctccctgaatattctattaaaaatttaattaaaaaattaaaagttaatataaaatagatgaataatatatttccaaaaaagta

SEQ ID NO: 454490 - DNA, 2693 bp, Homo sapiens
attggtaggtggtgtcacaaaggggcggggcgcggcggcagcggagcgttgtcggccagtgccttccgtgaagttgctcgccgggtcgttgggccctgtcgacctgtaggcgggcgagcgagccagcggacaagactgcgggtgaggctgagctagcgagcggccggcagggggggcgcccgggctgcgagccgctgagcccagccgcgctgccgccgccggccgtcgtggggccggaatggcgcaaggccggagtggcgcgggcgctcggcgctgggctgccgggtagagtcctgtccccgcccctcgccttgcggcctgacgccggccgctgctgcccggggaccggagcggcgggccgcctttgcccaggacacacgctctggcgtttgttcctttgggcgtgacgccagcttcaacgggtacgcggctttcccgacgggtgctgatctccgagtcgctgttgtcacgcggactgctgtcctccagattcaggccggtgggtctggggagcccggattggtcttggaggagcaacggctgcgcaggtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaaggtattcccatctgtcgacaacacttaatttggaataacatggaacttgaaaatgattattgcttgaatgattacaacatttcagaagggtgtaccttgaagctagttttggctatgcgtggcggacctataaatactagaagagttcctacagacgatccacttaggaagatggcagagtacttggattccagtcgagttgaggtctgggagaagacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgagtggtggttctatgtataattcagatacagatgaggatgaagaaactgagccttcttcttctgggcaacagataattgaaaattcaataactatgaataagatgaagctgctgaaggctaagatgaagaacatgaatctcagcaaaaagcctaagaaagctgtcaagataaaacctcacccacctgtagctcctcgaccttctagtggttccactgcaccatctcgccaccgattgttaagggtcctccccaacattggtcaatcttgttcacctgcttttgggaatgcatatccgcccgaaatctccaggaatggaatttcaagtttggcaactcaactctctgctgagagatacatatcttctatcactggtgaatttcttaaggaagataatagctgggagaataacacactgtctcacttcagtagcaacgtcaaactacctcctcagataccccatttggagttgggaaatgaccaggagcttgctgactctgttctccatcttggatcatccctgcctaggcaaacaaaacattttttaggaaacttgccatctagtaatgggaacattgtcttaccttcagaagaatgtgtaaccgaacaatcacttctacctaaagtgggctcactggcttcatttgcagaaggaaatgctgatgaacagagcagcggcttagaaggtgcgtgcaaagtgaatctggagttgctactcactaatgctgacaaagggttgaaagctccagagcagcatctcaagcatgttgcaggagtgctgaatggggaatcagtagagacttcagttcttaactaccgggaattaagtcctcacaagaatagactcttgtcacctcttcgctgttctgcaccaatgtcgctacataattctctggtgaaaccagagagacagtccaaatgttttgagtttgggaagctacagccttcttcttctcagtcactggatgttcaaaacataactgattcttctttctctaggactacttgctttcaaggtgttaaagttgattcacttgggaaaagatctgatgttatttccaaagttgaggctcgggatatcacagaaatgactaacaaggcttccaaagagcctgttggttgtgtaaataatatcagttttcttgcctcactggccgggagcacaagcagaaatagattacagagcacacgtggggcaggcaggcttcagaactctggaactgggctgtctacaaacctccagcattttcaggaagaaaactttaggaaaagttctccccagttagaacatacaggagtttttttggtcagtattttcctttcaacatgctctagtagttatccttgtagtgattcaacttatttaaagtttggtttttgtttacataaataaggaaggctaagattagattattttcataaatttatctgaaaatgtttatttagtttgtataaaatcttg

SEQ ID NO: 454491 - DNA, 2986 bp, Homo sapiens
cggcacgaggggaggcggcaccggaggggagggcagcgggcggcggcggcggcggtggaggagccggagcataatgctaaagaagtaaacaggtcatggcacgtttaacaaaaagacgacaggcggatacaaaagctatccagcatctttgggcagccattgagattatacggaaccagaagcagattgccaacattgaccgtattacaaattcctacagacgatccacttaggaagatggcagagtacttggattccagtcgagttgaggtctgggagaagacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgagtggtggttctatgtataattcagatacagatgaggatgaagaaactgagccttcttcttctgggcaacagataattgaaaattcaataactatgaataagatgaagctgctgaaggctaagatgaagaacatgaatctcagcaaaaaggtgaagctgttggcatttgaccaggcttatctctagcttacccctgcagagcactcagcaatgagcctaagaaagctgtcaagataaaacctcacccacctgtagctcctcgaccttctagtggttccactgcaccatctcgccaccgattgttaagggtcctccccaacattggtcaatcttgttcacctgcttttgggaatgcatatccgcccgaaatctccaggaatggaatttcaagtttggcaactcaactctctgctgagagatacatatcttctatcactggtgaatttcttaaggaagataatagctgggagaataacacactgtctcacttcagtagcaacgtcaaactacctcctcagataccccatttggagttgggaaatgaccaggagcttgctgactctgttctccatcttggatcatccctgcctaggcaaacaaaacattttttaggaaacttgccatctagtaatgggaacattgtcttaccttcagaagaatgtgtaaccgaacaatcacttctacctaaagtgggctcactggcttcatttgcagaaggaaatgctgatgaacagagcagcggcttagaaggtgcgtgcaaagtgaatctggagttgctactcactaatgctgacaaagggttgaaagctccagagcagcatctcaagcatgttgcaggagtgctgaatggggaatcagtagagacttcagttcttaactaccgggaattaagtcctcacaagaatagactcttgtcacctcttcgctgttctgcaccaatgtcgctacataattctctggtgaaaccagagagacagtccaaatgttttgagtttgggaagctacagccttcttcttctcagtcactggatgttcaaaacataactgattcttctttctctaggactacttgctttcaaggtgttaaagttgattcacttgggaaaagatctgatgttatttccaaagttgaggctcgggatatcacagaaatgactaacaaggcttccaaagagcctgttggttgtgtaaataatatcagttttcttgcctcactggccgggagcacaagcagaaatagattacagagcacacgtggggcaggcaggcttcagaactctggaactgggctgtctacaaacctccagcattttcaggaagaaaactttaggaaaagttctccccagttagaacatacaggagtttttttgtctacccatggtgttggaatgaatggaaataatgcagcagcagggaaaagcgtaggagaatgtactactcatcacctcccacctgtgaaagcccctcttcagacaaagaagaaaacaacaaatcattgttttctttgtggaaagaaaacaggactggctagtagctacgaatgcagatgtggaaacaacttctgtgcatctcatcgttatgcagaaactcatggctgtacctatgattacaagagtgcagggaggagatacttgcacgaggcaaatcctgtggttaatgcaccaaagcttccaaaaatctaactcttcctctacatcttactgttctgcccgggattcgtattataatgacagaagaaatgttgtttagactattatttttgttcgactctaaaagatttgccaaataacaaaagcatacaatgcatactgttggagaacaagaatgctactgtattttacatctttatttcttggtgaaacaaaagttttaaaagtagttttaacaactttacactggaatgatttagctttgttattgcatgtcttgtgttaagtgttttgtatatgatattgcagttttactaggcaaatcttcaaaagatgcactttaggaaacgaaatatttcctaaataaccaggcttccacattgtacagaatgagcagtcatgtaatgaatggctctactcagattgaccatatgggttttttctttttctttcttttattcttctccttctttttttttcagaggtgggatgggtggagattttttaaaaatcccacgtgtgaaagtttactggctttattagcaagttcctttttacttcaagctactttttataaaaaagaacatttttccagtgtggtttttaacagataatacatttcttccacattcagattagtattcggacatgaatccattctataaaacacatcgtgttcatgatagtgtatattttactactttttgaatgttaattttaaaatagaagatgtcccacttgccattaaatatagaagccaactttttaccttttgaaatatggctacatttaaaacaaaatctcacagctcggtttttcttatttgttgagtgctattaccaggagaaattcaaataaatattcaatttcattatgaaaaaaaaaat

SEQ ID NO: 454492 - DNA, 1424 bp, Homo sapiens
cgggcgggaggcggccgcgagccgggccggccgcgcgcaagtccggcgccagccgctagagcccccagtgcgcggcccggccgcggggcgcctcgacccgacacaataaactccgagggcgggcgggccgaggggccggtggggccgagcggccgccccgcgcgcatcgccatgtgagcggctgccgcggcttcgcggggacccaactttcccgggcggcggcgcccaacttcccgccgcccgctccggccccgtaggcccgcggcgccaggggaagacgcgagtaagtgcgggcggcggtgccctcccggccctcaccccgcacgcggcgacctcggccgcctagctctcccttcgctcaggcgcgaccgcggcgttctctgagctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagaggtaaagtcggtttcttttatttccacttcaagtacattttcttaactaacaagttaaagaataatgtagcagttaagcagattttggttgctcttctttccttgaaagtgtacttttttccacttcctaaaacaaaagacaggcataactaccaaatgaagcattattaatttgtaaatttcatgtgcttactctaatgcaaattaggtgtcatctttaaaaggcctggttttaaagatgagcagcttgtagcttcttgatccttgttgatttaagaaaatgccttacagcctgggcaatttagcatttcagatgtaaagaatgttttccaggtttagcagtggtacctgagagttcctctcagaaaaaaaaagtaaagcatagaactgatctgccgtcttgggaaacaat

SEQ ID NO: 454493 - DNA, 663 bp, Homo sapiens
gtaagttgcccacctcgcagtatccaggtggcaaatgaaacaggaaatattttcaaagtattttgtattttcaaagtatttcaaagacagtcactcttggtggatacttgtgaaattcagctgctgtcagtcaaatcatatccatcaagttgaaaccagtcttctgacttccctgtcattatctgttaccctggaatagcgtacatgctccaagtctccatcttaattaagcagccgctgaccaaagcttggctaagtaggaagggcacattgctattaatacatttcctgggagctctgatatttttcctaagtatgattaaaaacaacacatttatccagtatatcagttgtgccaacatttaaaaacttgaaggagactgtggttgagctcagccgttttaagtgatataagccctgcatgttttaaaactgtaaatctgggcacatttcaaacacatattcagtgagaagtggtttaggatttgaggaaatgtgttaatgaatctagtccaatgaagtaattataagttgacaataatttttatattctataaatttctgtgtttagtttattttaaaaacaaaacttatagtattgataagtaaaattataaatgaagcttatgtttataattattgtagctgttaattgcatgttct

SEQ ID NO: 454494 - DNA, 355 bp, Homo sapiens
tagtgagaatctcctcaggatgactaaaaatctgtacttctctcccgtgccaaatttaaaaaaattctgattcatggaaatctcatcagcctgttgtctgggttgcacaattatcagccttggctgataaaatgaaatcagacattctcatggaaatggattttgcctctttgggaatgatatggcaggtgtcaaaacatcttcatttatgatatactgaattcagagaagctcagctatactagattttcagtaatcctagatcataatatttattcccatttcattttttcttttaagaagtacattctttgaaatatattttcctgacattaacattgacaaaatggatgta

SEQ ID NO: 454495 - DNA, 690 bp, Homo sapiens
ggccctgtcgacctgtaggcgggcgagcgagccagcggacaagactgcgggtgaggctgagctagcgagcggccggcagggggggcgcccgggctgcgagccgctgagcccagccgcgctgccgccgccggccgtcgtggggccggaatggcgcaaggccggagtggcgcgggcgctcggcgctgggctgccgggtagagtcctgtccccgcccctcgccttgcggcctgacgccggccgctgctgcccggggaccggagcggcgggccgcctttgcccaggacacacgctctggcgtttgttcctttgggcgtgacgccagcttcaacgggtacgcggctttcccgacgggtgctgatctccgagtcgctgttgtcacgcggactgctgtcctccagattcaggccggtgggtctggggagcccggattggtcttggaggagcaacggctgcgcaggtgactcggtggcctcaagtgttaggtacctggatggcgcgaggagatgctggctctgaaatacttcccaattccgcttgcagatgaactccggactagagtttaggctacagacaagttaggcggttgatgtgattctgtagctcgtatttcgaactttagggatgttttgatgtatcagtaaatgtagatctgtgtcacagttttaatggcagcttcacattccggatatc

SEQ ID NO: 454496 - DNA, 369 bp, Homo sapiens
tattgaaaactttaaaatttaggcttaaaagattaagaaacaaaattcaacactatttatatacgtgaatgttaatttacatggatacattttatatagtttaatgtgtatgtatattttatgtaggctaaagtagtttcttttctttttcagctggatgaactgcagctttgcaagaattgcttttacttgtcaaatgctcgtcctgacaactggttctgttatccttgtgtatgtgaaatttttacctcaagtgtgtaacatacagctctaaggaagtttatttccagtttggttaaagattataattttcttcctaaatttttaaaatatcatagtatatatgggtttaatgagtataaacaactg

SEQ ID NO: 454497 - DNA, 457 bp, Homo sapiens
tgtggatggccttgctccagtcccgacctcttctgaggaataaggttcatgttggcactctgatgcaaatataaaatcagtcaatcccagaaaaaaaatctcgtatgtgtttaggagttatgaaagaaatattttagaaataatggattatatgtgactagtttaatattaatggtacacttgcatttaatactttaaaagtaatataacaaggtaaaacatttaatttccagatacctaatcatgagctggtttgggctaaaatgaaaggttttgggttttggccagccaaagtcatgcagaaagaagacaatcaagtcgacgttcgcttctttggccaccaccaccagaggtaatttgtgatcccatgttcagcggtcacagctgtgcttatgaagtccttaagaaagtttgatgatttctccatcagagatgcatgaagtttattttaaattgg

SEQ ID NO: 454498 - DNA, 4961 bp, Homo sapiens
cgggcgggaggcggccgcgagccgggccggccgcgcgcaagtccggcgccagccgctagagcccccagtgcgcggcccggccgcggggcgcctcgacccgacacaataaactccgagggcgggcgggccgaggggccggtggggccgagcggccgccccgcgcgcatcgccatgtgagcggctgccgcggcttcgcggggacccaactttcccgggcggcggcgcccaacttcccgccgcccgctccggccccgtaggcccgcggcgccaggggaagacgcgagtaagtgcgggcggcggtgccctcccggccctcaccccgcacgcggcgacctcggccgcctagctctcccttcgctcaggcgcgaccgcggcgttctctgagctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaggaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagccaaaaactacctttatccatatgtgaaattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaatgtctggattaagaagcattaccaataggaatggatcgatagttgaataatgattttttatacatagatatataaaatacagccaggaaaacttaaattacttttcttttaaaatatctcacaatttatgtggtatttttaaagactgatcttagaccaagtcaaattcccatttatcatttagttattttttgaggttagagaataatttgtacatatttatttagacctttgatatttattaaagcaattactcacaatggaagtgaaagaatcaggagaaaagccttttaaaaagtattctccaggtttgtcagggtcactctaaagataaaaatgtaactaagtcttctgtgaaatatcatccatctaatcttgatgctgttgcagatggtggtgacacaagttaattgacaaactactgccaaatggtgcacaatattttgtaaaaagtacccagtagccccatttcatacaatgtacctaaattatgcagtaacttggcatcatcgttccctccttgttgctgtgtaattagtcagtgttgccacagtgtgtggcgctgatggagatgtcagaaccgagaacacttaaccttctttgattgtttttcaagttttaagacttcgatccacccctatgagagcaagtaattgtggaaatatttttggtgtaaaatcattccagagtatgtaatatttaactgatagctgcatgaaagtgagattcgtgttactttggcttttctgtctctgttgacacggttgcacatttccaagttactacagcgtgaaaactgtgtgtttaaaaaaaaacaaaattaaaaaaagagattgtggcctggttttgtaaaagttttaggtaaaattacaattgattgttttaggaatcattattaaaaattttctgcaaatcataaagctatatcgaggtgttgagcttagccactatgcacattgtaattattcattgtggctgtccagttctatgatgcattctggcattttgtaagctgctctgactagcaatatatagattcatttaatgtgttaacattggttaataaatgtatttaaaaaaaactaaaaaaaaaaaaacaaacaacaaaaacacacaaccaacaacaacaaaaaaaacacaaaccaacaaaaaaaacacacacacacaacaaacaacacaaaaaaaagaagcgggggcggcgcgcccgcccaaaaaaaaccccccggcggggggagccccacacctccccccccccacctttttaacaaaggacgcgccccccacaggggcgcccaaaaacaccgaagcgacggcgcgcgcaaacccacccgtgggccgagagaccaaacgccctgtcggcatctcttgggagagcacaccctccctccgcggggcgaaaacagaggcggaaccccagccaacacagaaaattacgcggcgcggcaacaaacactgccgcgctatggggtcaccccggcaattctgcgctgaacaaactggcggataattataaaattagggggcagtgataacaaccccagacgatgcggcagtcactgcgaccacacgctctagcatacctcctaagacaggccgctgagaccgcgtgtgccgagcgcacgcgacccaaccaagagatcgcggaagccctcgcaggacatccagc

SEQ ID NO: 454499 - DNA, 4490 bp, Homo sapiens
cggcacgaggggaggcggcaccggaggggagggcagcgggcggcggcggcggcggtggaggagccggagcataatgctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaggaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagccaaaaactacctttatccatatgtgaaattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaatgtctggattaagaagcattaccaataggaatggatcgatagttgaataatgattttttatacatagatatataaaatacagccaggaaaacttaaattacttttcttttaaaatatctcacaatttatgtggtatttttaaagactgatcttagaccaagtcaaattcccatttatcatttagttattttttgaggttagagaataatttgtacatatttatttagacctttgatatttattaaagcaattactcacaatggaagtgaaagaatcaggagaaaagccttttaaaaagtattctccaggtttgtcagggtcactctaaagataaaaatgtaactaagtcttctgtgaaatatcatccatctaatcttgatgctgttgcagatggtggtgacacaagttaattgacaaactactgccaaatggtgcacaatattttgtaaaaagtacccagtagccccatttcatacaatgtacctaaattatgcagtaacttggcatcatcgttccctccttgttgctgtgtaattagtcagtgttgccacagtgtgtggcgctgatggagatgtcagaaccgagaacacttaaccttctttgattgtttttcaagttttaagacttcgatccacccctatgagagcaagtaattgtggaaatatttttggtgtaaaatcattccagagtatgtaatatttaactgatagctgcatgaaagtgagattcgtgttactttggcttttctgtctctgttgacacggttgcacatttccaagttactacagcgtgaaaactgtgtgtttaaaaaaaaacaaaattaaaaaaagagattgtggcctggttttgtaaaagttttaggtaaaattacaattgattgttttaggaatcattattaaaaattttctgcaaatcataaagctatatcgaggtgttgagcttagccactatgcacattgtaattattcattgtggctgtccagttctatgatgcattctggcattttgtaagctgctctgactagcaatatatagattcatttaatgtgttaacattggttaataaatgtatttaaaaaaaactaaaaaaaaaaaaacaaacaacaaaaacacacaaccaacaacaacaaaaaaaacacaaaccaacaaaaaaaacacacacacacaacaaacaacacaaaaaaaagaagcgggggcggcgcgcccgcccaaaaaaaaccccccggcggggggagccccacacctccccccccccacctttttaacaaaggacgcgccccccacaggggcgcccaaaaacaccgaagcgacggcgcgcgcaaacccacccgtgggccgagagaccaaacgccctgtcggcatctcttgggagagcacaccctccctccgcggggcgaaaacagaggcggaaccccagccaacacagaaaattacgcggcgcggcaacaaacactgccgcgctatggggtcaccccggcaattctgcgctgaacaaactggcggataattataaaattagggggcagtgataacaaccccagacgatgcggcagtcactgcgaccacacgctctagcatacctcctaagacaggccgctgagaccgcgtgtgccgagcgcacgcgacccaaccaagagatcgcggaagccctcgcaggacatccagc

SEQ ID NO: 454500 - DNA, 3391 bp, Homo sapiens
cgggcgggaggcggccgcgagccgggccggccgcgcgcaagtccggcgccagccgctagagcccccagtgcgcggcccggccgcggggcgcctcgacccgacacaataaactccgagggcgggcgggccgaggggccggtggggccgagcggccgccccgcgcgcatcgccatgtgagcggctgccgcggcttcgcggggacccaactttcccgggcggcggcgcccaacttcccgccgcccgctccggccccgtaggcccgcggcgccaggggaagacgcgagtaagtgcgggcggcggtgccctcccggccctcaccccgcacgcggcgacctcggccgcctagctctcccttcgctcaggcgcgaccgcggcgttctctgagctaaagaagtaaacaggtcatggcacgtttaacaaaaagacgacaggcggatacaaaagctatccagcatctttgggcagccattgagattatacggaaccagaagcagattgccaacattgaccgtattacaaaatgtgaaacaactacattattcttgaacctatggtgatttttacatcattacacagatatgtcattttcattagttgtatcattgttataaactggtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaggaatttgtagaagaaatcaagaagctggcaacacagcacaagcaactgatttctcagaccaagaagaagcagtggtgctacaactgtgaggaggaggccatgtaccactgctgctggaacacatcctactgctccatcaagtgccagcaggagcactggcacgcggagcacaagcgcacctgccgccggaaaagatgaagctggcccttcccggagtcaccccgatgattactcttttcagacacagcggtttttgtttccaagaagccaaaattgtttagaatttgcttcccattttgcaccagcctttaaacacttttcgtgaagaaattttgcacagtagtttaaatcttttgttaatgctcctccgaagtttttcagggggtaaaagtaacatcagtggagggtattattttaaataaattttaattgagaatttgttgcattttcagcaaattttaaaacatttttaggttttacagagattttaacctttaaacaacagatctttaaaaaacaggtgaatacaagtgagtttaacaaagaaacatttagaatagatctgaatgtaagaactacagaactgtttcagaaataaaacatactaccttgatgtgacatttttttcttaaccttgttgagctggttttgttcagcttaatttactgttcaaaggcattatctgttggtcacaccagtgggtatatgattgaatttagggaacagggttgacacagcagggctagtcctgcatattttttcttaaatatttcccaattgtgtttttcattatttcttttcaatatataacttttataacaaattattagctttgatcttgtagtttaaaattgcagggaactggggtaatcttttactgagctggatcttagagaaaatgaatatttaaattttaaagtttgcacatttcatctttgtcctaacatgagtgcttgtaacaaaataaacaacaaaaacaaagccaaaaactacctttatccatatgtgaaattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaat

SEQ ID NO: 454501 - DNA, 2266 bp, Homo sapiens
cgggcgggaggcggccgcgagccgggccggccgcgcgcaagtccggcgccagccgctagagcccccagtgcgcggcccggccgcggggcgcctcgacccgacacaataaactccgagggcgggcgggccgaggggccggtggggccgagcggccgccccgcgcgcatcgccatgtgagcggctgccgcggcttcgcggggacccaactttcccgggcggcggcgcccaacttcccgccgcccgctccggccccgtaggcccgcggcgccaggggaagacgcgagtaagtgcgggcggcggtgccctcccggccctcaccccgcacgcggcgacctcggccgcctagctctcccttcgctcaggcgcgaccgcggcgttctctgagctaaagaagtaaacaggtcatggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaggaatttgtagaagaaatcaagaagctggcaacacagcacaagcaactgatttctcagaccaagaagaagcagtgggtaaataccagtcttttttagacccttatttctgaaaatgtaccacaggtatgatgcccgttaattcagaaggtagctgtggcacatgcagaagatgtttctgaaataagatcaaatgtgaaatggtcagctttagttttaaaaattttattaaaagtcctatgatctctcaaccc

SEQ ID NO: 454502 - DNA, 3049 bp, Homo sapiens
attggtaggtggtgtcacaaaggggcggggcgcggcggcagcggagcgttgtcggccagtgccttccgtgaagttgctcgccgggtcgttgggccctgtcgacctgtaggcgggcgagcgagccagcggacaagactgcgggtgaggctgagctagcgagcggccggcagggggggcgcccgggctgcgagccgctgagcccagccgcgctgccgccgccggccgtcgtggggccggaatggcgcaaggccggagtggcgcgggcgctcggcgctgggctgccgggtagagtcctgtccccgcccctcgccttgcggcctgacgccggccgctgctgcccggggaccggagcggcgggccgcctttgcccaggacacacgctctggcgtttgttcctttgggcgtgacgccagcttcaacgggtacgcggctttcccgacgggtgctgatctccgagtcgctgttgtcacgcggactgctgtcctccagattcaggccggtgggtctggggagcccggattggtcttggaggagcaacggctgcgcaggtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaaggtattcccatctgtcgacaacacttaatttggaataacatggaacttgaaaatgattattgcttgaatgattacaacatttcagaagggtgtaccttgaagctagttttggctatgcgtggcggacctataaatactagaagagttcctacagacgatccacttaggaagatggcagagtacttggattccagtcgagttgaggtctgggagaagacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgagtggtggttctatgtataattcagatacagatgaggatgaagaaactgagccttcttcttctgggcaacagataattgaaaattcaataactatgaataagatgaagctgctgaaggctaagatgaagaacatgaatctcagcaaaaagcctaagaaagctgtcaagataaaacctcacccacctgtagctcctcgaccttctagtggttccactgcaccatctcgccaccgattgttaagggtcctccccaacattggtcaatcttgttcacctgcttttgggaatgcatatccgcccgaaatctccaggaatggaatttcaagtttggcaactcaactctctgctgagagatacatatcttctatcactggtgaatttcttaaggaagataatagctgggagaataacacactgtctcacttcagtagcaacgtcaaactacctcctcagataccccatttggagttgggaaatgaccaggagcttgctgactctgttctccatcttggatcatccctgcctaggcaaacaaaacattttttaggaaacttgccatctagtaatgggaacattgtcttaccttcagaagaatgtgtaaccgaacaatcacttctacctaaagtgggctcactggcttcatttgcagaaggaaatgctgatgaacagagcagcggcttagaaggtgcgtgcaaagtgaatctggagttgctactcactaatgctgacaaagggttgaaagctccagagcagcatctcaagcatgttgcaggagtgctgaatggggaatcagtagagacttcagttcttaactaccgggaattaagtcctcacaagaatagactcttgtcacctcttcgctgttctgcaccaatgtcgctacataattctctggtgaaaccagagagacagtccaaatgttttgagtttgggaagctacagccttcttcttctcagtcactggatgttcaaaacataactgattcttctttctctaggactacttgctttcaaggtgttaaagttgattcacttgggaaaagatctgatgttatttccaaagttgaggctcgggatatcacagaaatgactaacaaggcttccaaagagcctgttggttgtgtaaataatatcagttttcttgcctcactggccgggagcacaagcagaaatagattacagagcacacgtggggcaggcaggcttcagaactctggaactgggctgtctacaaacctccagcattttcaggaagaaaactttaggaaaagttctccccagttagaacatacaggagtttttttggagaatgtactactcatcacctcccacctgtgaaagcccctcttcagacaaagaagaaaacaacaaatcattgttttctttgtggaaagaaaacaggactggctagtagctacgaatgcaggcaggttggcgagctggagaagctcagatgctttctctgtgataacccagcttggggattatgcaaaataaaatatttaaattgcctgtttataacatcattaagatgatgttcaatagctatcttcagttgaacttctaattggctgaagtaaagaacaagtagatagctcatgggtttccaaaagacaaaaacagatccttccttgtcctttaagttaggaggtttaaaccaatctgagagtgtacctttttcgtcttatgatgaacctgcttggattttgtttgagtggcaccttggaagaacccctccctgaatattctattaaaaatttaattaaaaaattaaaagttaatataaaatagatgaataatatatttccaaaaaagta

SEQ ID NO: 454503 - DNA, 3827 bp, Homo sapiens
attggtaggtggtgtcacaaaggggcggggcgcggcggcagcggagcgttgtcggccagtgccttccgtgaagttgctcgccgggtcgttgggccctgtcgacctgtaggcgggcgagcgagccagcggacaagactgcgggtgaggctgagctagcgagcggccggcagggggggcgcccgggctgcgagccgctgagcccagccgcgctgccgccgccggccgtcgtggggccggaatggcgcaaggccggagtggcgcgggcgctcggcgctgggctgccgggtagagtcctgtccccgcccctcgccttgcggcctgacgccggccgctgctgcccggggaccggagcggcgggccgcctttgcccaggacacacgctctggcgtttgttcctttgggcgtgacgccagcttcaacgggtacgcggctttcccgacgggtgctgatctccgagtcgctgttgtcacgcggactgctgtcctccagattcaggccggtgggtctggggagcccggattggtcttggaggagcaacggctgcgcaggtgactcggtggcctcaagtgtgtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaagacccaggagatcctactgaagtgagtggctggccgagtccagtgaccacatcagcacattcagtaatgactcttgaagcttttgtctgccctaaatgatttggtattcccatctgtcgacaacacttaatttggaataacatggaacttgaaaatgattattgcttgaatgattacaacatttcagaagggtgtaccttgaagctagttttggctatgcgtggcggacctataaatactagaagagttcctacagacgatccacttaggaagatggcagagtacttggattccagtcgagttgaggtctgggagaagacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgagtggtggttctatgtataattcagatacagatgaggatgaagaaactgagccttcttcttctgggcaacagataattgaaaattcaataactatgaataagatgaagctgctgaaggctaagatgaagaacatgaatctcagcaaaaagcctaagaaagctgtcaagataaaacctcacccacctgtagctcctcgaccttctagtggttccactgcaccatctcgccaccgattgttaagggtcctccccaacattggtcaatcttgttcacctgcttttgggaatgcatatccgcccgaaatctccaggaatggaatttcaagtttggcaactcaactctctgctgagagatacatatcttctatcactggtgaatttcttaaggaagataatagctgggagaataacacactgtctcacttcagtagcaacgtcaaactacctcctcagataccccatttggagttgggaaatgaccaggagcttgctgactctgttctccatcttggatcatccctgcctaggcaaacaaaacattttttaggaaacttgccatctagtaatgggaacattgtcttaccttcagaagaatgtgtaaccgaacaatcacttctacctaaagtgggctcactggcttcatttgcagaaggaaatgctgatgaacagagcagcggcttagaaggtgcgtgcaaagtgaatctggagttgctactcactaatgctgacaaagggttgaaagctccagagcagcatctcaagcatgttgcaggagtgctgaatggggaatcagtagagacttcagttcttaactaccgggaattaagtcctcacaagaatagactcttgtcacctcttcgctgttctgcaccaatgtcgctacataattctctggtgaaaccagagagacagtccaaatgttttgagtttgggaagctacagccttcttcttctcagtcactggatgttcaaaacataactgattcttctttctctaggactacttgctttcaaggtgttaaagttgattcacttgggaaaagatctgatgttatttccaaagttgaggctcgggatatcacagaaatgactaacaaggcttccaaagagcctgttggttgtgtaaataatatcagttttcttgcctcactggccgggagcacaagcagaaatagattacagagcacacgtggggcaggcaggcttcagaactctggaactgggctgtctacaaacctccagcattttcaggaagaaaactttaggaaaagttctccccagttagaacatacaggagtttttttgtctacccatggtgttggaatgaatggaaataatgcagcagcagggaaaagcgtaggagaatgtactactcatcacctcccacctgtgaaagcccctcttcagacaaagaagaaaacaacaaatcattgttttctttgtggaaagaaaacaggactggctagtagctacgaatgcagatgtggaaacaacttctgtgcatctcatcgttatgcagaaactcatggctgtacctatgattacaagagtgcagggaggagatacttgcacgaggcaaatcctgtggttaatgcaccaaagcttccaaaaatctaactcttcctctacatcttactgttctgcccgggattcgtattataatgacagaagaaatgttgtttagactattatttttgttcgactctaaaagatttgccaaataacaaaagcatacaatgcatactgttggagaacaagaatgctactgtattttacatctttatttcttggtgaaacaaaagttttaaaagtagttttaacaactttacactggaatgatttagctttgttattgcatgtcttgtgttaagtgttttgtatatgatattgcagttttactaggcaaatcttcaaaagatgcactttaggaaacgaaatatttcctaaataaccaggcttccacattgtacagaatgagcagtcatgtaatgaatggctctactcagattgaccatatgggttttttctttttctttcttttattcttctccttctttttttttcagaggtgggatgggtggagattttttaaaaatcccacgtgtgaaagtttactggctttattagcaagttcctttttacttcaagctactttttataaaaaagaacatttttccagtgtggtttttaacagataatacatttcttccacattcagattagtattcggacatgaatccattctataaaacacatcgtgttcatgatagtgtatattttactactttttgaatgttaattttaaaatagaagatgtcccacttgccattaaatatagaagccaactttttaccttttgaaatatggctacatttaaaacaaaatctcacagctcggtttttcttatttgttgagtgctattaccaggagaaattcaaataaatattcaatttcattatgaaaaaaaaaat

SEQ ID NO: 454504 - DNA, 3296 bp, Homo sapiens
attggtaggtggtgtcacaaaggggcggggcgcggcggcagcggagcgttgtcggccagtgccttccgtgaagttgctcgccgggtcgttgggccctgtcgacctgtaggcgggcgagcgagccagcggacaagactgcgggtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaaggtattcccatctgtcgacaacacttaatttggaataacatggaacttgaaaatgattattgcttgaatgattacaacatttcagaagggtgtaccttgaagctagttttggctatgcgtggcggacctataaatactagaagagttcctacagacgatccacttaggaagatggcagagtacttggattccagtcgagttgaggtctgggagaagacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgagtggtggttctatgtataattcagatacagatgaggatgaagaaactgagccttcttcttctgggcaacagataattgaaaattcaataactatgaataagatgaagctgctgaaggctaagatgaagaacatgaatctcagcaaaaagcctaagaaagctgtcaagataaaacctcacccacctgtagctcctcgaccttctagtggttccactgcaccatctcgccaccgattgttaagggtcctccccaacattggtcaatcttgttcacctgcttttgggaatgcatatccgcccgaaatctccaggaatggaatttcaagtttggcaactcaactctctgctgagagatacatatcttctatcactggtgaatttcttaaggaagataatagctgggagaataacacactgtctcacttcagtagcaacgtcaaactacctcctcagataccccatttggagttgggaaatgaccaggagcttgctgactctgttctccatcttggatcatccctgcctaggcaaacaaaacattttttaggaaacttgccatctagtaatgggaacattgtcttaccttcagaagaatgtgtaaccgaacaatcacttctacctaaagtgggctcactggcttcatttgcagaaggaaatgctgatgaacagagcagcggcttagaaggtgcgtgcaaagtgaatctggagttgctactcactaatgctgacaaagggttgaaagctccagagcagcatctcaagcatgttgcaggagtgctgaatggggaatcagtagagacttcagttcttaactaccgggaattaagtcctcacaagaatagactcttgtcacctcttcgctgttctgcaccaatgtcgctacataattctctggtgaaaccagagagacagtccaaatgttttgagtttgggaagctacagccttcttcttctcagtcactggatgttcaaaacataactgattcttctttctctaggactacttgctttcaaggtgttaaagttgattcacttgggaaaagatctgatgttatttccaaagttgaggctcgggatatcacagaaatgactaacaaggcttccaaagagcctgttggttgtgtaaataatatcagttttcttgcctcactggccgggagcacaagcagaaatagattacagagcacacgtggggcaggcaggcttcagaactctggaactgggctgtctacaaacctccagcattttcaggaagaaaactttaggaaaagttctccccagttagaacatacaggagtttttttgtctacccatggtgttggaatgaatggaaataatgcagcagcagggaaaagcgtaggagaatgtactactcatcacctcccacctgtgaaagcccctcttcagacaaagaagaaaacaacaaatcattgttttctttgtggaaagaaaacaggactggctagtagctacgaatgcagatgtggaaacaacttctgtgcatctcatcgttatgcagaaactcatggctgtacctatgattacaagagtgcagggaggagatacttgcacgaggcaaatcctgtggttaatgcaccaaagcttccaaaaatctaactcttcctctacatcttactgttctgcccgggattcgtattataatgacagaagaaatgttgtttagactattatttttgttcgactctaaaagatttgccaaataacaaaagcatacaatgcatactgttggagaacaagaatgctactgtattttacatctttatttcttggtgaaacaaaagttttaaaagtagttttaacaactttacactggaatgatttagctttgttattgcatgtcttgtgttaagtgttttgtatatgatattgcagttttactaggcaaatcttcaaaagatgcactttaggaaacgaaatatttcctaaataaccaggcttccacattgtacagaatgagcagtcatgtaatgaatggctctactcagattgaccatatgggttttttctttttctttcttttattcttctccttctttttttttcagaggtgggatgggtggagattttttaaaaatcccacgtgtgaaagtttactggctttattagcaagttcctttttacttcaagctactttttataaaaaagaacatttttccagtgtggtttttaacagataatacatttcttccacattcagattagtattcggacatgaatccattctataaaacacatcgtgttcatgatagtgtatattttactactttttgaatgttaattttaaaatagaagatgtcccacttgccattaaatatagaagccaactttttaccttttgaaatatggctacatttaaaacaaaatctcacagctcggtttttcttatttgttgagtgctattaccaggagaaattcaaataaatattcaatttcattatgaaaaaaaaaat

SEQ ID NO: 454505 - DNA, 3577 bp, Homo sapiens
attggtaggtggtgtcacaaaggggcggggcgcggcggcagcggagcgttgtcggccagtgccttccgtgaagttgctcgccgggtcgttgggccctgtcgacctgtaggcgggcgagcgagccagcggacaagactgcgggtgaggctgagctagcgagcggccggcagggggggcgcccgggctgcgagccgctgagcccagccgcgctgccgccgccggccgtcgtggggccggaatggcgcaaggccggagtggcgcgggcgctcggcgctgggctgccgggtagagtcctgtccccgcccctcgccttgcggcctgacgccggccgctgctgcccggggaccggagcggcgggccgcctttgcccaggacacacgctctggcgtttgttcctttgggcgtgacgccagcttcaacgggtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaaggtattcccatctgtcgacaacacttaatttggaataacatggaacttgaaaatgattattgcttgaatgattacaacatttcagaagggtgtaccttgaagctagttttggctatgcgtggcggacctataaatactagaagagttcctacagacgatccacttaggaagatggcagagtacttggattccagtcgagttgaggtctgggagaagacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgagtggtggttctatgtataattcagatacagatgaggatgaagaaactgagccttcttcttctgggcaacagataattgaaaattcaataactatgaataagatgaagctgctgaaggctaagatgaagaacatgaatctcagcaaaaagcctaagaaagctgtcaagataaaacctcacccacctgtagctcctcgaccttctagtggttccactgcaccatctcgccaccgattgttaagggtcctccccaacattggtcaatcttgttcacctgcttttgggaatgcatatccgcccgaaatctccaggaatggaatttcaagtttggcaactcaactctctgctgagagatacatatcttctatcactggtgaatttcttaaggaagataatagctgggagaataacacactgtctcacttcagtagcaacgtcaaactacctcctcagataccccatttggagttgggaaatgaccaggagcttgctgactctgttctccatcttggatcatccctgcctaggcaaacaaaacattttttaggaaacttgccatctagtaatgggaacattgtcttaccttcagaagaatgtgtaaccgaacaatcacttctacctaaagtgggctcactggcttcatttgcagaaggaaatgctgatgaacagagcagcggcttagaaggtgcgtgcaaagtgaatctggagttgctactcactaatgctgacaaagggttgaaagctccagagcagcatctcaagcatgttgcaggagtgctgaatggggaatcagtagagacttcagttcttaactaccgggaattaagtcctcacaagaatagactcttgtcacctcttcgctgttctgcaccaatgtcgctacataattctctggtgaaaccagagagacagtccaaatgttttgagtttgggaagctacagccttcttcttctcagtcactggatgttcaaaacataactgattcttctttctctaggactacttgctttcaaggtgttaaagttgattcacttgggaaaagatctgatgttatttccaaagttgaggctcgggatatcacagaaatgactaacaaggcttccaaagagcctgttggttgtgtaaataatatcagttttcttgcctcactggccgggagcacaagcagaaatagattacagagcacacgtggggcaggcaggcttcagaactctggaactgggctgtctacaaacctccagcattttcaggaagaaaactttaggaaaagttctccccagttagaacatacaggagtttttttgtctacccatggtgttggaatgaatggaaataatgcagcagcagggaaaagcgtaggagaatgtactactcatcacctcccacctgtgaaagcccctcttcagacaaagaagaaaacaacaaatcattgttttctttgtggaaagaaaacaggactggctagtagctacgaatgcagatgtggaaacaacttctgtgcatctcatcgttatgcagaaactcatggctgtacctatgattacaagagtgcagggaggagatacttgcacgaggcaaatcctgtggttaatgcaccaaagcttccaaaaatctaactcttcctctacatcttactgttctgcccgggattcgtattataatgacagaagaaatgttgtttagactattatttttgttcgactctaaaagatttgccaaataacaaaagcatacaatgcatactgttggagaacaagaatgctactgtattttacatctttatttcttggtgaaacaaaagttttaaaagtagttttaacaactttacactggaatgatttagctttgttattgcatgtcttgtgttaagtgttttgtatatgatattgcagttttactaggcaaatcttcaaaagatgcactttaggaaacgaaatatttcctaaataaccaggcttccacattgtacagaatgagcagtcatgtaatgaatggctctactcagattgaccatatgggttttttctttttctttcttttattcttctccttctttttttttcagaggtgggatgggtggagattttttaaaaatcccacgtgtgaaagtttactggctttattagcaagttcctttttacttcaagctactttttataaaaaagaacatttttccagtgtggtttttaacagataatacatttcttccacattcagattagtattcggacatgaatccattctataaaacacatcgtgttcatgatagtgtatattttactactttttgaatgttaattttaaaatagaagatgtcccacttgccattaaatatagaagccaactttttaccttttgaaatatggctacatttaaaacaaaatctcacagctcggtttttcttatttgttgagtgctattaccaggagaaattcaaataaatattcaatttcattatgaaaaaaaaaat

SEQ ID NO: 454506 - DNA, 1495 bp, Homo sapiens
attggtaggtggtgtcacaaaggggcggggcgcggcggcagcggagcgttgtcggccagtgccttccgtgaagttgctcgccgggtcgttgggccctgtcgacctgtaggcgggcgagcgagccagcggacaagactgcgggtgaggctgagctagcgagcggccggcagggggggcgcccgggctgcgagccgctgagcccagccgcgctgccgccgccggccgtcgtggggccggaatggcgcaaggccggagtggcgcgggcgctcggcgctgggctgccgggtagagtcctgtccccgcccctcgccttgcggcctgacgccggccgctgctgcccggggaccggagcggcgggccgcctttgcccaggacacacgctctggcgtttgttcctttgggcgtgacgccagcttcaacgggtacgcggctttcccgacgggtgctgatctccgagtcgctgttgtcacgcggactgctgtcctccagattcaggccggtgggtctggggagcccggattggtcttggaggagcaacggctgcgcaggtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaaggtattcccatctgtcgacaacacttaatttggaataacatggaacttgaaaatgattattgcttgaatgattacaacatttcagaagggtgtaccttgaagctagttttggctatgcgtggcggacctataaatactagaagagttcctacagacgatccacttaggaagatggcagagtacttggattccagtcgagttgaggtctgggagaagacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgagtggtggttctatgtataattcagatacagatgaggatgaagaaactgagccttcttcttctgggcaacagataattgaaaattcaataactatgaataagatgaagctgctgaaggctaagatgaagaacatgaatctcagcaaaaaggtgaagctgttggcatttgaccaggcttatctctagcttacccctgcagagcactcagcaatgaggtctgttggtcattgtgaaaaaattataaagtattattcattaaaaaa

SEQ ID NO: 454507 - DNA, 5726 bp, Homo sapiens
ccggctgcctctgctgcagttcagagcaacttcaggagcttcccagccgagagcttcaggacgcctttcctgtcccactggcccagttgccacaacaaacaacagagaagacggtgaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagcttcagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttggatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaatggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctcaaaatccaaaaaaaa

SEQ ID NO: 454508 - DNA, 5573 bp, Homo sapiens
ccggctgcctctgctgcagttcagagcaacttcaggagcttcccagccgagagcttcaggacgcctttcctgtcccactggcccagttgccacaacaaacaacagagaagacggtgaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagcttcagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttggatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaatggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctcaaaatccaaaaaaaa

SEQ ID NO: 454509 - DNA, 342 bp, Homo sapiens
cacactgacagtgctgagcagagcaaggttgggttcgctcctctggcagaacctcggctctcaggaggtccttgttccagggaacagctgcttctctggggctgggctctactccctgcagcccctcgcactacccagctggaaccagggacaacgcctgagtccaaccctcgtgtctattttccagaaaacgggcaatgctgtgagagccattggaagactgtcctctatggcaatgatctcagggctcagtggcaggaaatcctcaacagggtcaccaaccagcccgctcaatgcagaaaaactagaatctgaaggaagatgtgtcccagccagctggtg

SEQ ID NO: 454510 - DNA, 404 bp, Homo sapiens
gctcggtacccactgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcaggtaattggccacggcactatctggggtcaaagaagtcatctaccatgggggttttgcctttaccttgctagactgacacctgggtatgtgatcccaggagacaccccactgcaaccccacccccaccctcagttccagctctgcatttttcaggctgagtttgctcatggagagcctctgcacagcctggctcctggtccccttccacagctttgtctttccatctgcctcccatgttgacagca

SEQ ID NO: 454511 - DNA, 6589 bp, Homo sapiens
  misc_feature (832)..(832): n is a, c, g, or t
  misc_feature (893)..(893): n is a, c, g, or t
  misc_feature (951)..(951): n is a, c, g, or t
  misc_feature (1001)..(1001): n is a, c, g, or t
tatgcttttctgtacactgctaagttacagcatttgggtttggaattttcagtagatgtttgtttgtccctggattggtttttttttccttctgtttagtgaacagaaacagattccatgccctcagggtatggtagcaccagccactattaagaagcccaaaggacagaacctgaagctttgacaatgtaccctagggctggggggagttcaaaggccaaagacgttcagcaccagggaagctggaaggagccagcagggtgggaccacggtgatgaggaagtgcctggggagggaaattttggtgtatacagcattctactaacagtctttccacccttccccctttttccaggtttggacagtgccaataggtatgtctaggctttgtgacttttacgttttccctcttgaaatgccctgcaaggatgttaccgagaaatgccctgaatttctgaatcatcttatggggcagaagaattggccatttggaggatgttgttttattttgggtgttttgtcttgttctcctattgtaatatgacacacgggttctatctctggttgctgtcagtattgagactggaaaactcagtgttgccacctttcacagtatctacacagtctcttctctggttagcatcctgaggaagaacactgctctgagaaggccgccttcctcattccagggcggaatctgttcactcatccagcccagacccagcaggagcctctttcctgtgtgtgaggctcggcgctagatgctggatgtgcaggggtgggcgtagaggagggcttaaaccacacgaacgcacattaccaactgggatgngtctgtgaggaaggacaacaggaaggcactgattagaatagaggggcagggaagccatttngggaacttggtatttgagctcagacctgtgcaaaggaatgttagctggtgaagaaaanctcagggagtgtgctccaaacagcagggatagcatgtacaagctgtgaancaagagatgggcccatggggacccagaaggacgccagtgtggccgcagcctggtgaatggcaggccaatgtctgtacgatcaggagctggcattcctgtgggccctcttgtggggctcagtttcattcttaaagtagtggaaaagctgttggaaaatccttgggcttgaaatgacataatttgattaatgtttttaaaagatcgactatggtcgctgtatagaaaatagattagagagggcagagtggacacgggacaccggtggcagaggttgaactacggaggcactagtagagaagggaactgtagggaaagcagggctctgggcagggttgtgggacaggcaagtgtcgggaatggctgcttgtgctgtggcttgggaaactgggcaaactgcagagaaagatgctcttacttgcccttaacttgtgggcttttgtgatccctggaatccgtgcttgtgatgagtaatatttgtgagtaaccagatgatcattctattctcccctctcctcacccaccctacccccaccctcaccaccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccaggtgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttggatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaatggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctcaaaatccaaaaaaaa

SEQ ID NO: 454512 - DNA, 6385 bp, Homo sapiens
  misc_feature (832)..(832): n is a, c, g, or t
  misc_feature (893)..(893): n is a, c, g, or t
  misc_feature (951)..(951): n is a, c, g, or t
  misc_feature (1001)..(1001): n is a, c, g, or t
tatgcttttctgtacactgctaagttacagcatttgggtttggaattttcagtagatgtttgtttgtccctggattggtttttttttccttctgtttagtgaacagaaacagattccatgccctcagggtatggtagcaccagccactattaagaagcccaaaggacagaacctgaagctttgacaatgtaccctagggctggggggagttcaaaggccaaagacgttcagcaccagggaagctggaaggagccagcagggtgggaccacggtgatgaggaagtgcctggggagggaaattttggtgtatacagcattctactaacagtctttccacccttccccctttttccaggtttggacagtgccaataggtatgtctaggctttgtgacttttacgttttccctcttgaaatgccctgcaaggatgttaccgagaaatgccctgaatttctgaatcatcttatggggcagaagaattggccatttggaggatgttgttttattttgggtgttttgtcttgttctcctattgtaatatgacacacgggttctatctctggttgctgtcagtattgagactggaaaactcagtgttgccacctttcacagtatctacacagtctcttctctggttagcatcctgaggaagaacactgctctgagaaggccgccttcctcattccagggcggaatctgttcactcatccagcccagacccagcaggagcctctttcctgtgtgtgaggctcggcgctagatgctggatgtgcaggggtgggcgtagaggagggcttaaaccacacgaacgcacattaccaactgggatgngtctgtgaggaaggacaacaggaaggcactgattagaatagaggggcagggaagccatttngggaacttggtatttgagctcagacctgtgcaaaggaatgttagctggtgaagaaaanctcagggagtgtgctccaaacagcagggatagcatgtacaagctgtgaancaagagatgggcccatggggacccagaaggacgccagtgtggccgcagcctggtgaatggcaggccaatgtctgtacgatcaggagctggcattcctgtgggccctcttgtggggctcagtttcattcttaaagtagtggaaaagctgttggaaaatccttgggcttgaaatgacataatttgattaatgtttttaaaagatcgactatggtcgctgtatagaaaatagattagagagggcagagtggacacgggacaccggtggcagaggttgaactacggaggcactagtagagaagggaactgtagggaaagcagggctctgggcagggttgtgggacaggcaagtgtcgggaatggctgcttgtgctgtggcttgggaaactgggcaaactgcagagaaagatgctcttacttgcccttaacttgtgggcttttgtgatccctggaatccgtgcttgtgatgagtaatatttgtgagtaaccagatgatcattctattctcccctctcctcacccaccctacccccaccctcaccaccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccaggtgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttggatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaatggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatccgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctcaaaatccaaaaaaaa

SEQ ID NO: 454513 - DNA, 1917 bp, Homo sapiens
tgacttgcatgtagactggaaaactagcaaaaaaaagcgagggggccttttttggagcaaataattatacatggggctttccgtacagataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctcaaaatccaaaaaaaa

SEQ ID NO: 454514 - DNA, 1823 bp, Homo sapiens
ctttttccctacactggttgcagggggagggagcctgccagctgcgaggacctctgtggtggaggagttggtgctgatggtggtggtagtgaccgctatggtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctcaaaatccaaaaaaaa

SEQ ID NO: 454515 - DNA, 1571 bp, Homo sapiens
atgagcctgccccgcttatccgtcacaacggtaggagagaaactgaagagccgaaggatgaagtggaggtgtcagatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctcaaaatccaaaaaaaa

SEQ ID NO: 454516 - DNA, 4371 bp, Homo sapiens
  misc_feature (832)..(832): n is a, c, g, or t
  misc_feature (893)..(893): n is a, c, g, or t
  misc_feature (951)..(951): n is a, c, g, or t
  misc_feature (1001)..(1001): n is a, c, g, or t
tatgcttttctgtacactgctaagttacagcatttgggtttggaattttcagtagatgtttgtttgtccctggattggtttttttttccttctgtttagtgaacagaaacagattccatgccctcagggtatggtagcaccagccactattaagaagcccaaaggacagaacctgaagctttgacaatgtaccctagggctggggggagttcaaaggccaaagacgttcagcaccagggaagctggaaggagccagcagggtgggaccacggtgatgaggaagtgcctggggagggaaattttggtgtatacagcattctactaacagtctttccacccttccccctttttccaggtttggacagtgccaataggtatgtctaggctttgtgacttttacgttttccctcttgaaatgccctgcaaggatgttaccgagaaatgccctgaatttctgaatcatcttatggggcagaagaattggccatttggaggatgttgttttattttgggtgttttgtcttgttctcctattgtaatatgacacacgggttctatctctggttgctgtcagtattgagactggaaaactcagtgttgccacctttcacagtatctacacagtctcttctctggttagcatcctgaggaagaacactgctctgagaaggccgccttcctcattccagggcggaatctgttcactcatccagcccagacccagcaggagcctctttcctgtgtgtgaggctcggcgctagatgctggatgtgcaggggtgggcgtagaggagggcttaaaccacacgaacgcacattaccaactgggatgngtctgtgaggaaggacaacaggaaggcactgattagaatagaggggcagggaagccatttngggaacttggtatttgagctcagacctgtgcaaaggaatgttagctggtgaagaaaanctcagggagtgtgctccaaacagcagggatagcatgtacaagctgtgaancaagagatgggcccatggggacccagaaggacgccagtgtggccgcagcctggtgaatggcaggccaatgtctgtacgatcaggagctggcattcctgtgggccctcttgtggggctcagtttcattcttaaagtagtggaaaagctgttggaaaatccttgggcttgaaatgacataatttgattaatgtttttaaaagatcgactatggtcgctgtatagaaaatagattagagagggcagagtggacacgggacaccggtggcagaggttgaactacggaggcactagtagagaagggaactgtagggaaagcagggctctgggcagggttgtgggacaggcaagtgtcgggaatggctgcttgtgctgtggcttgggaaactgggcaaactgcagagaaagatgctcttacttgcccttaacttgtgggcttttgtgatccctggaatccgtgcttgtgatgagtaatatttgtgagtaaccagatgatcattctattctcccctctcctcacccaccctacccccaccctcaccaccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccaggtgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttggatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaatggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgattcgcgaatgggtctagctcggttcgtata

SEQ ID NO: 454517 - DNA, 4414 bp, Homo sapiens
  misc_feature (832)..(832): n is a, c, g, or t
  misc_feature (893)..(893): n is a, c, g, or t
  misc_feature (951)..(951): n is a, c, g, or t
  misc_feature (1001)..(1001): n is a, c, g, or t
tatgcttttctgtacactgctaagttacagcatttgggtttggaattttcagtagatgtttgtttgtccctggattggtttttttttccttctgtttagtgaacagaaacagattccatgccctcagggtatggtagcaccagccactattaagaagcccaaaggacagaacctgaagctttgacaatgtaccctagggctggggggagttcaaaggccaaagacgttcagcaccagggaagctggaaggagccagcagggtgggaccacggtgatgaggaagtgcctggggagggaaattttggtgtatacagcattctactaacagtctttccacccttccccctttttccaggtttggacagtgccaataggtatgtctaggctttgtgacttttacgttttccctcttgaaatgccctgcaaggatgttaccgagaaatgccctgaatttctgaatcatcttatggggcagaagaattggccatttggaggatgttgttttattttgggtgttttgtcttgttctcctattgtaatatgacacacgggttctatctctggttgctgtcagtattgagactggaaaactcagtgttgccacctttcacagtatctacacagtctcttctctggttagcatcctgaggaagaacactgctctgagaaggccgccttcctcattccagggcggaatctgttcactcatccagcccagacccagcaggagcctctttcctgtgtgtgaggctcggcgctagatgctggatgtgcaggggtgggcgtagaggagggcttaaaccacacgaacgcacattaccaactgggatgngtctgtgaggaaggacaacaggaaggcactgattagaatagaggggcagggaagccatttngggaacttggtatttgagctcagacctgtgcaaaggaatgttagctggtgaagaaaanctcagggagtgtgctccaaacagcagggatagcatgtacaagctgtgaancaagagatgggcccatggggacccagaaggacgccagtgtggccgcagcctggtgaatggcaggccaatgtctgtacgatcaggagctggcattcctgtgggccctcttgtggggctcagtttcattcttaaagtagtggaaaagctgttggaaaatccttgggcttgaaatgacataatttgattaatgtttttaaaagatcgactatggtcgctgtatagaaaatagattagagagggcagagtggacacgggacaccggtggcagaggttgaactacggaggcactagtagagaagggaactgtagggaaagcagggctctgggcagggttgtgggacaggcaagtgtcgggaatggctgcttgtgctgtggcttgggaaactgggcaaactgcagagaaagatgctcttacttgcccttaacttgtgggcttttgtgatccctggaatccgtgcttgtgatgagtaatatttgtgagtaaccagatgatcattctattctcccctctcctcacccaccctacccccaccctcaccaccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccaggtgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttggatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaatggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgggtaggtcgtgcccacccatcgccgccacccatacacaggggtcccatttctcagcccctcccttccttaccat

SEQ ID NO: 454518 - DNA, 236 bp, Homo sapiens
tggacaatggcgtcgaatgtgatcagaatgcctgagacccttctgcctcgctcactttctccctgtcctccctcagcaatgccccctcagatcatccagttccctgaggaccagaaggtacgcgcaggagagtcagtggagctgtttggcaaagtgacaggcactcagcccatcacctgtacctggatgaagttccgaaagcaggtcagtgacggtatggggtgggcactgggggt

SEQ ID NO: 454519 - DNA, 5933 bp, Homo sapiens
ccggctgcctctgctgcagttcagagcaacttcaggagcttcccagccgagagcttcaggacgcctttcctgtcccactggcccagttgccacaacaaacaacagagaagacggtgaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagcttcagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccaggtgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttggatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaatggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctcaaaatccaaaaaaaa

SEQ ID NO: 454520 - DNA, 5780 bp, Homo sapiens
ccggctgcctctgctgcagttcagagcaacttcaggagcttcccagccgagagcttcaggacgcctttcctgtcccactggcccagttgccacaacaaacaacagagaagacggtgaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagcttcagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccaggtgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttggatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaatggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctcaaaatccaaaaaaaa

SEQ ID NO: 454521 - DNA, 3108 bp, Homo sapiens
  misc_feature (832)..(832): n is a, c, g, or t
  misc_feature (893)..(893): n is a, c, g, or t
  misc_feature (951)..(951): n is a, c, g, or t
  misc_feature (1001)..(1001): n is a, c, g, or t
tatgcttttctgtacactgctaagttacagcatttgggtttggaattttcagtagatgtttgtttgtccctggattggtttttttttccttctgtttagtgaacagaaacagattccatgccctcagggtatggtagcaccagccactattaagaagcccaaaggacagaacctgaagctttgacaatgtaccctagggctggggggagttcaaaggccaaagacgttcagcaccagggaagctggaaggagccagcagggtgggaccacggtgatgaggaagtgcctggggagggaaattttggtgtatacagcattctactaacagtctttccacccttccccctttttccaggtttggacagtgccaataggtatgtctaggctttgtgacttttacgttttccctcttgaaatgccctgcaaggatgttaccgagaaatgccctgaatttctgaatcatcttatggggcagaagaattggccatttggaggatgttgttttattttgggtgttttgtcttgttctcctattgtaatatgacacacgggttctatctctggttgctgtcagtattgagactggaaaactcagtgttgccacctttcacagtatctacacagtctcttctctggttagcatcctgaggaagaacactgctctgagaaggccgccttcctcattccagggcggaatctgttcactcatccagcccagacccagcaggagcctctttcctgtgtgtgaggctcggcgctagatgctggatgtgcaggggtgggcgtagaggagggcttaaaccacacgaacgcacattaccaactgggatgngtctgtgaggaaggacaacaggaaggcactgattagaatagaggggcagggaagccatttngggaacttggtatttgagctcagacctgtgcaaaggaatgttagctggtgaagaaaanctcagggagtgtgctccaaacagcagggatagcatgtacaagctgtgaancaagagatgggcccatggggacccagaaggacgccagtgtggccgcagcctggtgaatggcaggccaatgtctgtacgatcaggagctggcattcctgtgggccctcttgtggggctcagtttcattcttaaagtagtggaaaagctgttggaaaatccttgggcttgaaatgacataatttgattaatgtttttaaaagatcgactatggtcgctgtatagaaaatagattagagagggcagagtggacacgggacaccggtggcagaggttgaactacggaggcactagtagagaagggaactgtagggaaagcagggctctgggcagggttgtgggacaggcaagtgtcgggaatggctgcttgtgctgtggcttgggaaactgggcaaactgcagagaaagatgctcttacttgcccttaacttgtgggcttttgtgatccctggaatccgtgcttgtgatgagtaatatttgtgagtaaccagatgatcattctattctcccctctcctcacccaccctacccccaccctcaccaccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcaggtctgtctctgcagctctctcttggggattaacatgaaaatggtcttggttgcaatgggtattgctctccgaggacccgctcagatccttgatccaccagaaaatcagatgggaccatcaggtgatggacccaaagaaatggagactcttgtcctctcttttctgccttctctgggtaggattttctggattcatgattaaatggtccagaggaagaagatggccatagagctagagcagtgaaagattaatttgaaaatatagtgtggccagtgtagctggaaggttttgaagactggtacaaaaccagattatgggccgggcacggtggctcacgcctgtaatcccagcactttgtgaggccgaggcagcagatcacaaggtcaggagatcgagaccatcctggctaacacggtgaaaccctgtctctactaaaaaatacaaaaaattagctgggtgtggtggccggtgcctgtagtcccagctactcgggaggctgaggcaggagaatggcgtgaacctgggaggtggagcttgcagtgagccgagatcgcaccactgcactccagcctgggcgacagagcaaagactctgtctc

SEQ ID NO: 454522 - DNA, 379 bp, Homo sapiens
gagtgaaggcaggcccaggggagagtccatggagaagaaaggccatccccacttctctctggggcaaccagaagacccaactccgaagggaggcagccccagagggcccctctgcaggctcactctgctccgtctccatcgagaaggcactgcctgaggacagaggcttatacaagtgtgtagccaagaatgacgctggccaggcggagtgctcctgccaagtcaccgtggatgatgctccagcctagtgagaacaccaaggccccagagaactggatgatctgagggggcattgctgccttcggaggtgtcttgggggcaggtttctttttcacagtcgcatcactctcagttcctaactaaggaagagagctcttgg

SEQ ID NO: 454523 - DNA, 2828 bp, Homo sapiens
gctcggtacactagtcacggttggctagtggctttcagggttctcaccaacccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaatggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctcaaaatccaaaaaaaa

SEQ ID NO: 454524 - DNA, 2284 bp, Homo sapiens
agagcgaggtccgtgtgggagacttcctagaggagatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctcaaaatccaaaaaaaa

SEQ ID NO: 454525 - DNA, 6589 bp, Homo sapiens
  misc_feature (832)..(832): n is a, c, g, or t
  misc_feature (893)..(893): n is a, c, g, or t
  misc_feature (951)..(951): n is a, c, g, or t
  misc_feature (1001)..(1001): n is a, c, g, or t
tatgcttttctgtacactgctaagttacagcatttgggtttggaattttcagtagatgtttgtttgtccctggattggtttttttttccttctgtttagtgaacagaaacagattccatgccctcagggtatggtagcaccagccactattaagaagcccaaaggacagaacctgaagctttgacaatgtaccctagggctggggggagttcaaaggccaaagacgttcagcaccagggaagctggaaggagccagcagggtgggaccacggtgatgaggaagtgcctggggagggaaattttggtgtatacagcattctactaacagtctttccacccttccccctttttccaggtttggacagtgccaataggtatgtctaggctttgtgacttttacgttttccctcttgaaatgccctgcaaggatgttaccgagaaatgccctgaatttctgaatcatcttatggggcagaagaattggccatttggaggatgttgttttattttgggtgttttgtcttgttctcctattgtaatatgacacacgggttctatctctggttgctgtcagtattgagactggaaaactcagtgttgccacctttcacagtatctacacagtctcttctctggttagcatcctgaggaagaacactgctctgagaaggccgccttcctcattccagggcggaatctgttcactcatccagcccagacccagcaggagcctctttcctgtgtgtgaggctcggcgctagatgctggatgtgcaggggtgggcgtagaggagggcttaaaccacacgaacgcacattaccaactgggatgngtctgtgaggaaggacaacaggaaggcactgattagaatagaggggcagggaagccatttngggaacttggtatttgagctcagacctgtgcaaaggaatgttagctggtgaagaaaanctcagggagtgtgctccaaacagcagggatagcatgtacaagctgtgaancaagagatgggcccatggggacccagaaggacgccagtgtggccgcagcctggtgaatggcaggccaatgtctgtacgatcaggagctggcattcctgtgggccctcttgtggggctcagtttcattcttaaagtagtggaaaagctgttggaaaatccttgggcttgaaatgacataatttgattaatgtttttaaaagatcgactatggtcgctgtatagaaaatagattagagagggcagagtggacacgggacaccggtggcagaggttgaactacggaggcactagtagagaagggaactgtagggaaagcagggctctgggcagggttgtgggacaggcaagtgtcgggaatggctgcttgtgctgtggcttgggaaactgggcaaactgcagagaaagatgctcttacttgcccttaacttgtgggcttttgtgatccctggaatccgtgcttgtgatgagtaatatttgtgagtaaccagatgatcattctattctcccctctcctcacccaccctacccccaccctcaccaccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccaggtgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttggatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaatggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagacgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctcaaaatccaaaaaaaa

SEQ ID NO: 454526 - DNA, 1028 bp, Homo sapiens
gcacgagctcgtgccgctcgtgccgcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctcaaaatccaaaaaaaa

SEQ ID NO: 454527 - DNA, 4098 bp, Homo sapiens
  misc_feature (832)..(832): n is a, c, g, or t
  misc_feature (893)..(893): n is a, c, g, or t
  misc_feature (951)..(951): n is a, c, g, or t
  misc_feature (1001)..(1001): n is a, c, g, or t
  misc_feature (3974)..(3974): n is a, c, g, or t
tatgcttttctgtacactgctaagttacagcatttgggtttggaattttcagtagatgtttgtttgtccctggattggtttttttttccttctgtttagtgaacagaaacagattccatgccctcagggtatggtagcaccagccactattaagaagcccaaaggacagaacctgaagctttgacaatgtaccctagggctggggggagttcaaaggccaaagacgttcagcaccagggaagctggaaggagccagcagggtgggaccacggtgatgaggaagtgcctggggagggaaattttggtgtatacagcattctactaacagtctttccacccttccccctttttccaggtttggacagtgccaataggtatgtctaggctttgtgacttttacgttttccctcttgaaatgccctgcaaggatgttaccgagaaatgccctgaatttctgaatcatcttatggggcagaagaattggccatttggaggatgttgttttattttgggtgttttgtcttgttctcctattgtaatatgacacacgggttctatctctggttgctgtcagtattgagactggaaaactcagtgttgccacctttcacagtatctacacagtctcttctctggttagcatcctgaggaagaacactgctctgagaaggccgccttcctcattccagggcggaatctgttcactcatccagcccagacccagcaggagcctctttcctgtgtgtgaggctcggcgctagatgctggatgtgcaggggtgggcgtagaggagggcttaaaccacacgaacgcacattaccaactgggatgngtctgtgaggaaggacaacaggaaggcactgattagaatagaggggcagggaagccatttngggaacttggtatttgagctcagacctgtgcaaaggaatgttagctggtgaagaaaanctcagggagtgtgctccaaacagcagggatagcatgtacaagctgtgaancaagagatgggcccatggggacccagaaggacgccagtgtggccgcagcctggtgaatggcaggccaatgtctgtacgatcaggagctggcattcctgtgggccctcttgtggggctcagtttcattcttaaagtagtggaaaagctgttggaaaatccttgggcttgaaatgacataatttgattaatgtttttaaaagatcgactatggtcgctgtatagaaaatagattagagagggcagagtggacacgggacaccggtggcagaggttgaactacggaggcactagtagagaagggaactgtagggaaagcagggctctgggcagggttgtgggacaggcaagtgtcgggaatggctgcttgtgctgtggcttgggaaactgggcaaactgcagagaaagatgctcttacttgcccttaacttgtgggcttttgtgatccctggaatccgtgcttgtgatgagtaatatttgtgagtaaccagatgatcattctattctcccctctcctcacccaccctacccccaccctcaccaccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccaggtgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttggatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaancagctcatgaggctacggaaacaggccgagaagaacgtggagaagaaaattgacaaatacacagaggtcctcaagacccacggactcctggtctgagcccaataaagactgttaattcctcaaa

SEQ ID NO: 454528 - DNA, 308 bp, Homo sapiens
aggccacatatagtctccatcacattcttctttttttattttataacctttaaagaaatgtaaaagccattgttagcctgcagaccccacagaaatagggccaggcagtttcccgaccctggctctggttcatcagttttgattgctgtataatgttagctagaccatgctttattaatccattcttccatcagtgatgcttggtccatttttaagcttttgctgttgggcagagtgtattctcagtatcttctggtatacatgagccaaagtatctttgggaagttctccaggaggtgtggaattgc

SEQ ID NO: 454529 - DNA, 656 bp, Homo sapiens
ttttttttaatccccgcaccaagcgcttaacctcattggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttaggtaaccttcagcgaacaaagagggcaacctcccagatacgtctgctggggagggagtcatcgtgactgccctctaggcttttgctgggatctgggatttgaattcccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtaagctgtgctttagaaggcacttttggaggtggctgggctgcactggtagatcaaaattggccctta

SEQ ID NO: 454530 - DNA, 626 bp, Homo sapiens
acctaatggaaaactgcttttctgtttttatttccctaatctataagcacaggaaaagtgtgtgtgtgcatgtgtctttttacacttaactctttgttgtagattttgtttggtgtgactcacagtcatttcacctttctatttcttcctcaatcactcccatccctcattggacctgtcagaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgaggtgaggaccacagcaagaatatgagctaagtttgaatctcctgttggactcttcaggggtttaagaggtctgcttgcaggaacaggcactaaaggtaccaagatgactaagacacagtccttgccatccatttgctttgccatccatttgctttgaaatatctggcaaatatcctttttttctttactttttttttttt

SEQ ID NO: 454531 - DNA, 8626 bp, Homo sapiens
ttttttttaatccccgcaccaagcgcttaacctcattggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttaggtaaccttcagcgaacaaagagggcaacctcccagatacgtctgctggggagggagtcatcgtgactgccctctaggcttttgctgggatctgggatttgaattcccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtggttctgctgggcatggacatcctgtccgccctggtgacccggctgcaggatcggttcaaggcgcagatcggcacagtgctgccaagtctaatagacagactaggagatgctaaagactctgtgagggagcaggaccaaactctgctgctaaagatcatggatcaagctgctaatccccagtacgtatgggacagaatgcttggaggcttcaaacacaagaatttccgtactcgagaaggcatctgtctctgccttatagcaacactcaatgcctctggagcacagactttaacactaagcaagattgtgccacatatatgcaacttacttggagatccaaacagccaggttcgagatgcagcaataaacagcttagtggaaatttacagacatgtaggagaacgtgtgagggcagatctcagtaaaaaaggattgccacagtcccggttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttaggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagcacggagcagccgtatccctcgacccagcatgagtcaggggtgcagccgcgataccagccgtgagagcagccgagatacaagccctgctcggggctttcctccacttgatcggtttgggcttggccagccaggaagaatacctggttctgtgaatgccatgagagttctgagcacaagtacagatcttgaagctgctgttgctgatgctttgaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaagagagttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtggtgagtgctttggtcacgattggtgcctatgtgatgtccatgacctctgcgtagcccttatctagaacctactctaatagaataccccgtttccttgtcctctttcaggaaatgtcgagcatcctgaggatggggccatcttaagccccagtgaatgaatgaatctgatatttaagtatgccgttttttctcaggttgttcagtcaactacattttcactaggttatccagttagtcattcattcactgagttggtcttatttttcaacactggaaagatgcaagtgctcaattttgtctgtcactctagcacacccaacatcaatcatttgactccaggagtgcttgtatgatgattattcatttttggtttatatacacttaaaattggccttatgattctaagggaaaaaaaaaaccatcctgggcagattctacccatttatttacatgtgggttaaaagaccaaggaaagaatagaatatattctatatacagcccttgaataacgatgcctattctgcttcaccccagggctctccaagcaatacgattggccggacgccctcccgacacaccagcagcaggaccagccccctgacctcacccaccaactgttcccatgggggtctgtctccaagtcggttatggggttggagtgccgacgggttagcgaagcacccacctcccttttctcagcctaactccatccccaccgctccctcccacaaggctctcaggcgctcttactctcccagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtcccttccagcttttctgtagaatcttactggtattgaatgtaaaggaagcaaggcctgtattgcagtcttcatacaaaacaaaaggaataagaacagaaaagagccatactgaaacatgtcttgtacagcctgctgagatggcgaaaccctgtgtgtggggtgcagtttttaaaaatcagagcgctctagccactacttggtagaaagtagcattttttttttcagttaataacatatttgggggtggggtggggtgttactttgtgttcttcctccttagcctattttcttgtgcgtatggtctgtgtggggcccctttcacagctgacaccacgaaaggtgatatatctttaagttgtgttctgagacctactaaaaatgggaatcaagtcttggcaagaacagtctgaagatggccttttaacaaacgctgggaattttgcttgtcatatccagactggaggccgactgccctggctttcagcgtagaattgggagtgcaccctgacagtctccttccagctctccctaatcgactccaccgacaaggtccctaccccagagcttccatgcaaaggaattcttcaagtttaaatctggacacaaaaataagataaatgtatggcatcatttagggatgcctgagatggcagttcatgaagcacagaagataaagaagaagtctttcatctttactgctgagatccttgggaacactgttgtcatgggggctctgccaagaccctcatctctgggctacacggtgattcagattgagcaccaacttgtttcctcccctcaaagttctgcctaagccgttcagttctaacatggtctcagttaatctggtaaatggcatctttaccatcttagttctgacttctcagtttaatgtgggattaagagccaagaaaagcctagagagactggatatcacaattttttttaattttataaactgaagtagttccttgaatgtctgttgatgaaatagtcactgtttaaggaaaaaagtaattatgaggtgtagcagattgcagaaaaacaggattagaaacacacttaaaaagaacacacatttagagtctctcttcctcctcagcgaaccactaggccccctttttaaaaacacctttagagcctaattactccaataaaagtaactagaggtttggagtctggttaaataaattctgagtaaaattcttaagccaaatggaaattcttaatgcaatcatgaggacttctattgtctcttactgttgtattagatcctataaattgaactgatttttccataaggaaaatgcttcttttgagattaattctaataacgtatttgctattgcagtgcagagcccactgcaactgctaggactgaaagcagaggctgggtgccagagcacgtgattcttaacatcatttccacagacccctctgccctgaccctctgcattggatgcaggaagctgggaaagactgatgttgatttggaaacatgggctgaaaatgaaggccccatagtgcataggaacagtaaagccagggtgctgacgtgtgtgtgtgtgtgtgtgtgtgtgtgtgtgtgtgtgtgtgttgtgtgtgtttgtgcgtgcaccctacacatgtgtggtacctcactgctgctgtttagggaacttgagggacgcgtttcaaggggttgggtattactgacgagctttggctcaaaatatagcaggaccaggtcttttgttgataagtactgtttgtttattaatatgtcattaatggtatttcttttttacactctacaagtgaattagggagtctcttgttgacccctttgttgcaggaatgtgcgtcgggctaggttatccatgagtttctttattcctaatgcagttagaaagacctttctccttgagctctttgactcccagaaggtaccccagtccccagtgtacttagaaaggatctcgaacattgctggacgtcctcatagtactcacaaagggctagccttgaatgtcactcgcccagtcttcagtctcctgacttagagatacaatcacgtcacaggtctcttggcctcaatctgaaaactgctgccgccgcgccgaggagactcgcatgccgccaccacctcactgggagggcgccgagcccaccgtcgccccctagaccctgacagctgcagctgccttgccttgccgccgcctccctgcagggcccctgttccaatgaaaaacagaacacaaaagagcagagcacctaagcctgtctctgcctccctgtctaccggactggccagggcccaagacccccgctgctccactgcggggctgggcgggctgactccctgcttcctccaagctgctgcctcccctgcagccagggtctgggcagggtgcagccggtcctcggggcacgcagcttccttcaagtacactgtgtgtgcttcccggacctgcggcgatgccacgggcctgccttttctatgcgcctcactagcttaccaccctgtgcaggtaatgcaactgactttgtctcatcagtctttttctttccctgccaccctttatttatcaagcgtaatgttacactttaaaggacagcaaataagaactttgtagaatcccaccaggactttgctaacaataatgtttggaaataaagaagtgctctgaaaaaatatcagccaccaaaatagttatgttggcactgtgttcacacgcatggtccccacacccccaggttgggtgggtttttttgttttttgggtttttttggggggggggctttttcatgttacatccatatctgtatttatatcttatttgtttcactttcaagtgtatcatggcaaatgtacagatttttttgttaataatgtgctaggatttgctaaaaaagaaaacaaaaaaaacccttttgagtttgccctagaataaatgagacttaattca

SEQ ID NO: 454532 - DNA, 8526 bp, Homo sapiens
ttttttttaatccccgcaccaagcgcttaacctcattggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttaggtaaccttcagcgaacaaagagggcaacctcccagatacgtctgctggggagggagtcatcgtgactgccctctaggcttttgctgggatctgggatttgaattcccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtggttctgctgggcatggacatcctgtccgccctggtgacccggctgcaggatcggttcaaggcgcagatcggcacagtgctgccaagtctaatagacagactaggagatgctaaagactctgtgagggagcaggaccaaactctgctgctaaagatcatggatcaagctgctaatccccagtacgtatgggacagaatgcttggaggcttcaaacacaagaatttccgtactcgagaaggcatctgtctctgccttatagcaacactcaatgcctctggagcacagactttaacactaagcaagattgtgccacatatatgcaacttacttggagatccaaacagccaggttcgagatgcagcaataaacagcttagtggaaatttacagacatgtaggagaacgtgtgagggcagatctcagtaaaaaaggattgccacagtcccggttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttaggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagcacggagcagccgtatccctcgacccagcatgagtcaggggtgcagccgcgataccagccgtgagagcagccgagatacaagccctgctcggggctttcctccacttgatcggtttgggcttggccagccaggaagaatacctggttctgtgaatgccatgagagttctgagcacaagtacagatcttgaagctgctgttgctgatgctttgaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaagagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtggtgagtgctttggtcacgattggtgcctatgtgatgtccatgacctctgcgtagcccttatctagaacctactctaatagaataccccgtttccttgtcctctttcaggaaatgtcgagcatcctgaggatggggccatcttaagccccagtgaatgaatgaatctgatatttaagtatgccgttttttctcaggttgttcagtcaactacattttcactaggttatccagttagtcattcattcactgagttggtcttatttttcaacactggaaagatgcaagtgctcaattttgtctgtcactctagcacacccaacatcaatcatttgactccaggagtgcttgtatgatgattattcatttttggtttatatacacttaaaattggccttatgattctaagggaaaaaaaaaaccatcctgggcagattctacccatttatttacatgtgggttaaaagaccaaggaaagaatagaatatattctatatacagcccttgaataacgatgcctattctgcttcaccccagggctctccaagcaatacgattggccggacgccctcccgacacaccagcagcaggaccagccccctgacctcacccaccaactgttcccatgggggtctgtctccaagtcggttatggggttggagtgccgacgggttagcgaagcacccacctcccttttctcagcctaactccatccccaccgctccctcccacaaggctctcaggcgctcttactctcccagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtcccttccagcttttctgtagaatcttactggtattgaatgtaaaggaagcaaggcctgtattgcagtcttcatacaaaacaaaaggaataagaacagaaaagagccatactgaaacatgtcttgtacagcctgctgagatggcgaaaccctgtgtgtggggtgcagtttttaaaaatcagagcgctctagccactacttggtagaaagtagcattttttttttcagttaataacatatttgggggtggggtggggtgttactttgtgttcttcctccttagcctattttcttgtgcgtatggtctgtgtggggcccctttcacagctgacaccacgaaaggtgatatatctttaagttgtgttctgagacctactaaaaatgggaatcaagtcttggcaagaacagtctgaagatggccttttaacaaacgctgggaattttgcttgtcatatccagactggaggccgactgccctggctttcagcgtagaattgggagtgcaccctgacagtctccttccagctctccctaatcgactccaccgacaaggtccctaccccagagcttccatgcaaaggaattcttcaagtttaaatctggacacaaaaataagataaatgtatggcatcatttagggatgcctgagatggcagttcatgaagcacagaagataaagaagaagtctttcatctttactgctgagatccttgggaacactgttgtcatgggggctctgccaagaccctcatctctgggctacacggtgattcagattgagcaccaacttgtttcctcccctcaaagttctgcctaagccgttcagttctaacatggtctcagttaatctggtaaatggcatctttaccatcttagttctgacttctcagtttaatgtgggattaagagccaagaaaagcctagagagactggatatcacaattttttttaattttataaactgaagtagttccttgaatgtctgttgatgaaatagtcactgtttaaggaaaaaagtaattatgaggtgtagcagattgcagaaaaacaggattagaaacacacttaaaaagaacacacatttagagtctctcttcctcctcagcgaaccactaggccccctttttaaaaacacctttagagcctaattactccaataaaagtaactagaggtttggagtctggttaaataaattctgagtaaaattcttaagccaaatggaaattcttaatgcaatcatgaggacttctattgtctcttactgttgtattagatcctataaattgaactgatttttccataaggaaaatgcttcttttgagattaattctaataacgtatttgctattgcagtgcagagcccactgcaactgctaggactgaaagcagaggctgggtgccagagcacgtgattcttaacatcatttccacagacccctctgccctgaccctctgcattggatgcaggaagctgggaaagactgatgttgatttggaaacatgggctgaaaatgaaggccccatagtgcataggaacagtaaagccagggtgctgacgtgtgtgtgtgtgtgtgtgtgtgtgtgtgtgtgtgtgtgtgttgtgtgtgtttgtgcgtgcaccctacacatgtgtggtacctcactgctgctgtttagggaacttgagggacgcgtttcaaggggttgggtattactgacgagctttggctcaaaatatagcaggaccaggtcttttgttgataagtactgtttgtttattaatatgtcattaatggtatttcttttttacactctacaagtgaattagggagtctcttgttgacccctttgttgcaggaatgtgcgtcgggctaggttatccatgagtttctttattcctaatgcagttagaaagacctttctccttgagctctttgactcccagaaggtaccccagtccccagtgtacttagaaaggatctcgaacattgctggacgtcctcatagtactcacaaagggctagccttgaatgtcactcgcccagtcttcagtctcctgacttagagatacaatcacgtcacaggtctcttggcctcaatctgaaaactgctgccgccgcgccgaggagactcgcatgccgccaccacctcactgggagggcgccgagcccaccgtcgccccctagaccctgacagctgcagctgccttgccttgccgccgcctccctgcagggcccctgttccaatgaaaaacagaacacaaaagagcagagcacctaagcctgtctctgcctccctgtctaccggactggccagggcccaagacccccgctgctccactgcggggctgggcgggctgactccctgcttcctccaagctgctgcctcccctgcagccagggtctgggcagggtgcagccggtcctcggggcacgcagcttccttcaagtacactgtgtgtgcttcccggacctgcggcgatgccacgggcctgccttttctatgcgcctcactagcttaccaccctgtgcaggtaatgcaactgactttgtctcatcagtctttttctttccctgccaccctttatttatcaagcgtaatgttacactttaaaggacagcaaataagaactttgtagaatcccaccaggactttgctaacaataatgtttggaaataaagaagtgctctgaaaaaatatcagccaccaaaatagttatgttggcactgtgttcacacgcatggtccccacacccccaggttgggtgggtttttttgttttttgggtttttttggggggggggctttttcatgttacatccatatctgtatttatatcttatttgtttcactttcaagtgtatcatggcaaatgtacagatttttttgttaataatgtgctaggatttgctaaaaaagaaaacaaaaaaaacccttttgagtttgccctagaataaatgagacttaattca

SEQ ID NO: 454533 - DNA, 8537 bp, Homo sapiens
ttttttttaatccccgcaccaagcgcttaacctcattggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttaggtaaccttcagcgaacaaagagggcaacctcccagatacgtctgctggggagggagtcatcgtgactgccctctaggcttttgctgggatctgggatttgaattcccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtggttctgctgggcatggacatcctgtccgccctggtgacccggctgcaggatcggttcaaggcgcagatcggcacagtgctgccaagtctaatagacagactaggagatgctaaagactctgtgagggagcaggaccaaactctgctgctaaagatcatggatcaagctgctaatccccagtacgtatgggacagaatgcttggaggcttcaaacacaagaatttccgtactcgagaaggcatctgtctctgccttatagcaacactcaatgcctctggagcacagactttaacactaagcaagattgtgccacatatatgcaacttacttggagatccaaacagccaggttcgagatgcagcaataaacagcttagtggaaatttacagacatgtaggagaacgtgtgagggcagatctcagtaaaaaaggattgccacagtcccggttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttaggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagcacggagcagccgtatccctcgacccagcatgagtcaggggtgcagccgcgataccagccgtgagagcagccgagatacaagccctgctcggggctttcctccacttgatcggtttgggcttggccagccaggaagaatacctggttctgtgaatgccatgagagttctgagcacaagtacagatcttgaagctgctgttgctgatgctttgaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaagagagttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtggtgagtgctttggtcacgattggtgcctatgtgatgtccatgacctctgcgtagcccttatctagaacctactctaatagaataccccgtttccttgtcctctttcaggaaatgtcgagcatcctgaggatggggccatcttaagccccagtgaatgaatgaatctgatatttaagtatgccgttttttctcaggttgttcagtcaactacattttcactaggttatccagttagtcattcattcactgagttggtcttatttttcaacactggaaagatgcaagtgctcaattttgtctgtcactctagcacacccaacatcaatcatttgactccaggagtgcttgtatgatgattattcatttttggtttatatacacttaaaattggccttatgattctaagggaaaaaaaaaaccatcctgggcagattctacccatttatttacatgtgggttaaaagaccaaggaaagaatagaatatattctatatacagcccttgaataacgatgcctattctgcttcaccccagggctctccaagcaatacgattggccggacgccctcccgacacaccagcagcaggaccagccccctgacctcacccaccaactgttcccatgggggtctgtctccaagtcggttatggggttggagtgccgacgggttagcgaagcacccacctcccttttctcagcctaactccatccccaccgctccctcccacaaggctctcaggcgctcttactctcccagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtcccttccagcttttctgtagaatcttactggtattgaatgtaaaggaagcaaggcctgtattgcagtcttcatacaaaacaaaaggaataagaacagaaaagagccatactgaaacatgtcttgtacagcctgctgagatggcgaaaccctgtgtgtggggtgcagtttttaaaaatcagagcgctctagccactacttggtagaaagtagcattttttttttcagttaataacatatttgggggtggggtggggtgttactttgtgttcttcctccttagcctattttcttgtgcgtatggtctgtgtggggcccctttcacagctgacaccacgaaaggtgatatatctttaagttgtgttctgagacctactaaaaatgggaatcaagtcttggcaagaacagtctgaagatggccttttaacaaacgctgggaattttgcttgtcatatccagactggaggccgactgccctggctttcagcgtagaattgggagtgcaccctgacagtctccttccagctctccctaatcgactccaccgacaaggtccctaccccagagcttccatgcaaaggaattcttcaagtttaaatctggacacaaaaataagataaatgtatggcatcatttagggatgcctgagatggcagttcatgaagcacagaagataaagaagaagtctttcatctttactgctgagatccttgggaacactgttgtcatgggggctctgccaagaccctcatctctgggctacacggtgattcagattgagcaccaacttgtttcctcccctcaaagttctgcctaagccgttcagttctaacatggtctcagttaatctggtaaatggcatctttaccatcttagttctgacttctcagtttaatgtgggattaagagccaagaaaagcctagagagactggatatcacaattttttttaattttataaactgaagtagttccttgaatgtctgttgatgaaatagtcactgtttaaggaaaaaagtaattatgaggtgtagcagattgcagaaaaacaggattagaaacacacttaaaaagaacacacatttagagtctctcttcctcctcagcgaaccactaggccccctttttaaaaacacctttagagcctaattactccaataaaagtaactagaggtttggagtctggttaaataaattctgagtaaaattcttaagccaaatggaaattcttaatgcaatcatgaggacttctattgtctcttactgttgtattagatcctataaattgaactgatttttccataaggaaaatgcttcttttgagattaattctaataacgtatttgctattgcagtgcagagcccactgcaactgctaggactgaaagcagaggctgggtgccagagcacgtgattcttaacatcatttccacagacccctctgccctgaccctctgcattggatgcaggaagctgggaaagactgatgttgatttggaaacatgggctgaaaatgaaggccccatagtgcataggaacaatgtgtggtacctcactgctgctgtttagggaacttgagggacgcgtttcaaggggttgggtattactgacgagctttggctcaaaatatagcaggaccaggtcttttgttgataagtactgtttgtttattaatatgtcattaatggtatttcttttttacactctacaagtgaattagggagtctcttgttgacccctttgttgcaggaatgtgcgtcgggctaggttatccatgagtttctttattcctaatgcagttagaaagacctttctccttgagctctttgactcccagaaggtaccccagtccccagtgtacttagaaaggatctcgaacattgctggacgtcctcatagtactcacaaagggctagccttgaatgtcactcgcccagtcttcagtctcctgacttagagatacaatcacgtcacaggtctcttggcctcaatctgaaaactgctgccgccgcgccgaggagactcgcatgccgccaccacctcactgggagggcgccgagcccaccgtcgccccctagaccctgacagctgcagctgccttgccttgccgccgcctccctgcagggcccctgttccaatgaaaaacagaacacaaaagagcagagcacctaagcctgtctctgcctccctgtctaccggactggccagggcccaagacccccgctgctccactgcggggctgggcgggctgactccctgcttcctccaagctgctgcctcccctgcagccagggtctgggcagggtgcagccggtcctcggggcacgcagcttccttcaagtacactgtgtgtgcttcccggacctgcggcgatgccacgggcctgccttttctatgcgcctcactagcttaccaccctgtgcaggtaatgcaactgactttgtctcatcagtctttttctttccctgccaccctttatttatcaagcgtaatgttacactttaaaggacagcaaataagaactttgtagaatcccaccaggactttgctaacaataatgtttggaaataaagaagtgctctgaaaaaatatcagccaccaaaatagttatgttggcactgtgttcacacgcatggtccccacacccccaggttgggtgggtttttttgttttttgggtttttttggggggggggctttttcatgttacatccatatctgtatttatatcttatttgtttcactttcaagtgtatcatggcaaatgtacagatttttttgttaataatgtgctaggatttgctaaaaaagaaaacaaaaaaaacccttttgagtttgccctagaataaatgagacttaattca

SEQ ID NO: 454534 - DNA, 3621 bp, Homo sapiens
taaaggtgtgaaggttagaggatttgccctctgaccttggcccagccacttcccccctgtggagcggggttctcaccctgctttttccctggctctgatggagcctttgggctgcagtcgtgcttgagatgaatggccctgcccccgtatcccttcctccatgagctgctgcggcccacctagttgtgacacctggtggtggtcttgtaattgcccacggcttttccctctcctctggactctggcctcctccctccctctgtggccctagcacctggcagatgcattggatgggcagcaggcactcagaacatgtttttataatgaattcctcaaccaagggaactaagggacttgctgtttccttactgtcacctgggattctttttgctgttttctactttctgattgcttttcttcctgctaattcagtttcatcttctcttttcagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtcccttccagcttttctgtagaatcttactggtattgaatgtaaaggaagcaaggcctgtattgcagtcttcatacaaaacaaaaggaataagaacagaaaagagccatactgaaacatgtcttgtacagcctgctgagatggcgaaaccctgtgtgtggggtgcagtttttaaaaatcagagcgctctagccactacttggtagaaagtagcattttttttttcagttaataacatatttgggggtggggtggggtgttactttgtgttcttcctccttagcctattttcttgtgcgtatggtctgtgtggggcccctttcacagctgacaccacgaaaggtgatatatctttaagttgtgttctgagacctactaaaaatgggaatcaagtcttggcaagaacagtctgaagatggccttttaacaaacgctgggaattttgcttgtcatatccagactggaggccgactgccctggctttcagcgtagaattgggagtgcaccctgacagtctccttccagctctccctaatcgactccaccgacaaggtccctaccccagagcttccatgcaaaggaattcttcaagtttaaatctggacacaaaaataagataaatgtatggcatcatttagggatgcctgagatggcagttcatgaagcacagaagataaagaagaagtctttcatctttactgctgagatccttgggaacactgttgtcatgggggctctgccaagaccctcatctctgggctacacggtgattcagattgagcaccaacttgtttcctcccctcaaagttctgcctaagccgttcagttctaacatggtctcagttaatctggtaaatggcatctttaccatcttagttctgacttctcagtttaatgtgggattaagagccaagaaaagcctagagagactggatatcacaattttttttaattttataaactgaagtagttccttgaatgtctgttgatgaaatagtcactgtttaaggaaaaaagtaattatgaggtgtagcagattgcagaaaaacaggattagaaacacacttaaaaagaacacacatttagagtctctcttcctcctcagcgaaccactaggccccctttttaaaaacacctttagagcctaattactccaataaaagtaactagaggtttggagtctggttaaataaattctgagtaaaattcttaagccaaatggaaattcttaatgcaatcatgaggacttctattgtctcttactgttgtattagatcctataaattgaactgatttttccataaggaaaatgcttcttttgagattaattctaataacgtatttgctattgcagtgcagagcccactgcaactgctaggactgaaagcagaggctgggtgccagagcacgtgattcttaacatcatttccacagacccctctgccctgaccctctgcattggatgcaggaagctgggaaagactgatgttgatttggaaacatgggctgaaaatgaaggccccatagtgcataggaacagtaaagccagggtgctgacgtgtgtgtgtgtgtgtgtgtgtgtgtgtgtgtgtgtgtgtgttgtgtgtgtttgtgcgtgcaccctacacatgtgtggtacctcactgctgctgtttagggaacttgagggacgcgtttcaaggggttgggtattactgacgagctttggctcaaaatatagcaggaccaggtcttttgttgataagtactgtttgtttattaatatgtcattaatggtatttcttttttacactctacaagtgaattagggagtctcttgttgacccctttgttgcaggaatgtgcgtcgggctaggttatccatgagtttctttattcctaatgcagttagaaagacctttctccttgagctctttgactcccagaaggtaccccagtccccagtgtacttagaaaggatctcgaacattgctggacgtcctcatagtactcacaaagggctagccttgaatgtcactcgcccagtcttcagtctcctgacttagagatacaatcacgtcacaggtctcttggcctcaatctgaaaactgctgccgccgcgccgaggagactcgcatgccgccaccacctcactgggagggcgccgagcccaccgtcgccccctagaccctgacagctgcagctgccttgccttgccgccgcctccctgcagggcccctgttccaatgaaaaacagaacacaaaagagcagagcacctaagcctgtctctgcctccctgtctaccggactggccagggcccaagacccccgctgctccactgcggggctgggcgggctgactccctgcttcctccaagctgctgcctcccctgcagccagggtctgggcagggtgcagccggtcctcggggcacgcagcttccttcaagtacactgtgtgtgcttcccggacctgcggcgatgccacgggcctgccttttctatgcgcctcactagcttaccaccctgtgcaggtaatgcaactgactttgtctcatcagtctttttctttccctgccaccctttatttatcaagcgtaatgttacactttaaaggacagcaaataagaactttgtagaatcccaccaggactttgctaacaataatgtttggaaataaagaagtgctctgaaaaaatatcagccaccaaaatagttatgttggcactgtgttcacacgcatggtccccacacccccaggttgggtgggtttttttgttttttgggtttttttggggggggggctttttcatgttacatccatatctgtatttatatcttatttgtttcactttcaagtgtatcatggcaaatgtacagatttttttgttaataatgtgctaggatttgctaaaaaagaaaacaaaaaaaacccttttgagtttgccctagaataaatgagacttaattca

SEQ ID NO: 454535 - DNA, 5123 bp, Homo sapiens
ttttttttaatccccgcaccaagcgcttaacctcattggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttaggtaaccttcagcgaacaaagagggcaacctcccagatacgtctgctggggagggagtcatcgtgactgccctctaggcttttgctgggatctgggatttgaattcccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtggttctgctgggcatggacatcctgtccgccctggtgacccggctgcaggatcggttcaaggcgcagatcggcacagtgctgccaagtctaatagacagactaggagatgctaaagactctgtgagggagcaggaccaaactctgctgctaaagatcatggatcaagctgctaatccccagtacgtatgggacagaatgcttggaggcttcaaacacaagaatttccgtactcgagaaggcatctgtctctgccttatagcaacactcaatgcctctggagcacagactttaacactaagcaagattgtgccacatatatgcaacttacttggagatccaaacagccaggttcgagatgcagcaataaacagcttagtggaaatttacagacatgtaggagaacgtgtgagggcagatctcagtaaaaaaggattgccacagtcccggttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttaggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagcacggagcagccgtatccctcgacccagcatgagtcaggggtgcagccgcgataccagccgtgagagcagccgagatacaagccctgctcggggctttcctccacttgatcggtttgggcttggccagccaggaagaatacctggttctgtgaatgccatgagagttctgagcacaagtacagatcttgaagctgctgttgctgatgctttgaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaagagagttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtggtgagtgctttggtcacgattggtgcctatgtgatgtccatgacctctgcgtagcccttatctagaacctactctaatagaataccccgtttccttgtcctctttcaggaaatgtcgagcatcctgaggatggggccatcttaagccccagtgaatgaatgaatctgatatttaagtatgccgttttttctcaggttgttcagtcaactacattttcactaggttatccagttagtcattcattcactgagttggtcttatttttcaacactggaaagatgcaagtgctcaattttgtctgtcactctagcacacccaacatcaatcatttgactccaggagtgcttgtatgatgattattcatttttggtttatatacacttaaaattggccttatgattctaagggaaaaaaaaaaccatcctgggcagattctacccatttatttacatgtgggttaaaagaccaaggaaagaatagaatatattctatatacagcccttgaataacgatgcctattctgcttcaccccagggctctccaagcaatacgattggccggacgccctcccgacacaccagcagcaggaccagccccctgacctcacccaccaactgttcccatgggggtctgtctccaagtcggttatggggttggagtgccgacgggttagcgaagcacccacctcccttttctcagcctaactccatccccaccgctccctcccacaaggctctcaggcgctcttactctcccagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagacgtgagatgctggtttggccttatcttgcccctttccatgtaatggggtcacgatgtccttttcttattgggcttagcttcagctttactttctgggttgtgcttactgtttacatcaaaa

SEQ ID NO: 454536 - DNA, 3073 bp, Homo sapiens
ttttttttaatccccgcaccaagcgcttaacctcattggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttaggtaaccttcagcgaacaaagagggcaacctcccagatacgtctgctggggagggagtcatcgtgactgccctctaggcttttgctgggatctgggatttgaattcccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtggttctgctgggcatggacatcctgtccgccctggtgacccggctgcaggatcggttcaaggcgcagatcggcacagtgctgccaagtctaatagacagactaggagatgctaaagactctgtgagggagcaggaccaaactctgctgctaaagatcatggatcaagctgctaatccccagtacgtatgggacagaatgcttggaggcttcaaacacaagaatttccgtactcgagaaggcatctgtctctgccttatagcaacactcaatgcctctggagcacagactttaacactaagcaagattgtgccacatatatgcaacttacttggagatccaaacagccaggttcgagatgcagcaataaacagcttagtggaaatttacagacatgtaggagaacgtgtgagggcagatctcagtaaaaaaggattgccacagtcccggttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttaggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagcacggagcagccgtatccctcgacccagcatgagtcaggggtgcagccgcgataccagccgtgagagcagccgagatacaagccctgctcggggctttcctccacttgatcggtttgggcttggccagccaggaagaatacctggttctgtgaatgccatgagagttctgagcacaagtacagatcttgaagctgctgttgctgatgctttggtaagaggcacagtatgtatgtacacagtctttttgaaatactcatctgcatttctctctgtcctaacaggaaattgcccccaaatcaggttatgaattcatctttgaaactctttaaaattgtgttaatgttgggtaaatttatattgttattgtttgccccttaaacttttacctctgcacacatataagtgaaaatggactttacagaaaatattagcatcaagtatttcttatctgtgctcttcagtatcaag

SEQ ID NO: 454537 - DNA, 485 bp, Homo sapiens
gttatgtcatttcatgaggagacgccctagatgtgagcattttttccttatttcacttcttcgtagtaagcagaaacatggtccatttctttggggtttatagtcttcaataacaagaaaacaaatgtaattgatacattacaattgagatcacttgtagtttccttcggcattgcctgaactctcttcagggaccaggagaaactgtttgtcagttttttatgctccagcatttgttaaaacttggtatttgttttcaggaaagcaaaacaacatcagattttagcaatgtattttcaaaattctatgtagtccttattcatatttcctcctttatcactaaagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagca

SEQ ID NO: 454538 - DNA, 421 bp, Homo sapiens
agagttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaaggtaagtgtttaagggttaggtccattttgatgttacaggatacttgtaagtgactttttgccattctcttttgttacccatggcctttgtcacccccttgaatatctcttttactcagttctcactttctgttgttgacatacttgttgacatgtcccaccagtccatgaaatgaaataccatatcttccttgtgttgatattacttttgtgagtatttaagacatatataataaacaaatgtaaaactttgga

SEQ ID NO: 454539 - DNA, 721 bp, Homo sapiens
ttttttttaatccccgcaccaagcgcttaacctcattggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttaggtaaccttcagcgaacaaagagggcaacctcccagatacgtctgctggggagggagtcatcgtgactgccctctaggcttttgctgggatctgggatttgaattcccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtggttctgctgggcatggacatcctgtccgccctggtgacccggctgcaggatcggttcaaggcgcagatcggcacaggtgagctgcggcacttgtggagcggacccggccccttcagacccccagccgagcc

SEQ ID NO: 454540 - DNA, 8092 bp, Homo sapiens
ttttttttaatccccgcaccaagcgcttaacctcattggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttaggtaaccttcagcgaacaaagagggcaacctcccagatacgtctgctggggagggagtcatcgtgactgccctctaggcttttgctgggatctgggatttgaattcccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtggttctgctgggcatggacatcctgtccgccctggtgacccggctgcaggatcggttcaaggcgcagatcggcacagtgctgccaagtctaatagacagactaggagatgctaaagactctgtgagggagcaggaccaaactctgctgctaaagatcatggatcaagctgctaatccccagtacgtatgggacagaatgcttggaggcttcaaacacaagaatttccgtactcgagaaggcatctgtctctgccttatagcaacactcaatgcctctggagcacagactttaacactaagcaagattgtgccacatatatgcaacttacttggagatccaaacagccaggttcgagatgcagcaataaacagcttagtggaaatttacagacatgtaggagaacgtgtgagggcagatctcagtaaaaaaggattgccacagtcccggttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttaggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagcacggagcagccgtatccctcgacccagcatgagtcaggggtgcagccgcgataccagccgtgagagcagccgagatacaagccctgctcggggctttcctccacttgatcggtttgggcttggccagccaggaagaatacctggttctgtgaatgccatgagagttctgagcacaagtacagatcttgaagctgctgttgctgatgctttgaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaagagagttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtgggctctccaagcaatacgattggccggacgccctcccgacacaccagcagcaggaccagccccctgacctcacccaccaactgttcccatgggggtctgtctccaagtcggttatggggttggagtgccgacgggttagcgaagcacccacctcccttttctcagcctaactccatccccaccgctccctcccacaaggctctcaggcgctcttactctcccagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtcccttccagcttttctgtagaatcttactggtattgaatgtaaaggaagcaaggcctgtattgcagtcttcatacaaaacaaaaggaataagaacagaaaagagccatactgaaacatgtcttgtacagcctgctgagatggcgaaaccctgtgtgtggggtgcagtttttaaaaatcagagcgctctagccactacttggtagaaagtagcattttttttttcagttaataacatatttgggggtggggtggggtgttactttgtgttcttcctccttagcctattttcttgtgcgtatggtctgtgtggggcccctttcacagctgacaccacgaaaggtgatatatctttaagttgtgttctgagacctactaaaaatgggaatcaagtcttggcaagaacagtctgaagatggccttttaacaaacgctgggaattttgcttgtcatatccagactggaggccgactgccctggctttcagcgtagaattgggagtgcaccctgacagtctccttccagctctccctaatcgactccaccgacaaggtccctaccccagagcttccatgcaaaggaattcttcaagtttaaatctggacacaaaaataagataaatgtatggcatcatttagggatgcctgagatggcagttcatgaagcacagaagataaagaagaagtctttcatctttactgctgagatccttgggaacactgttgtcatgggggctctgccaagaccctcatctctgggctacacggtgattcagattgagcaccaacttgtttcctcccctcaaagttctgcctaagccgttcagttctaacatggtctcagttaatctggtaaatggcatctttaccatcttagttctgacttctcagtttaatgtgggattaagagccaagaaaagcctagagagactggatatcacaattttttttaattttataaactgaagtagttccttgaatgtctgttgatgaaatagtcactgtttaaggaaaaaagtaattatgaggtgtagcagattgcagaaaaacaggattagaaacacacttaaaaagaacacacatttagagtctctcttcctcctcagcgaaccactaggccccctttttaaaaacacctttagagcctaattactccaataaaagtaactagaggtttggagtctggttaaataaattctgagtaaaattcttaagccaaatggaaattcttaatgcaatcatgaggacttctattgtctcttactgttgtattagatcctataaattgaactgatttttccataaggaaaatgcttcttttgagattaattctaataacgtatttgctattgcagtgcagagcccactgcaactgctaggactgaaagcagaggctgggtgccagagcacgtgattcttaacatcatttccacagacccctctgccctgaccctctgcattggatgcaggaagctgggaaagactgatgttgatttggaaacatgggctgaaaatgaaggccccatagtgcataggaacagtaaagccagggtgctgacgtgtgtgtgtgtgtgtgtgtgtgtgtgtgtgtgtgtgtgtgttgtgtgtgtttgtgcgtgcaccctacacatgtgtggtacctcactgctgctgtttagggaacttgagggacgcgtttcaaggggttgggtattactgacgagctttggctcaaaatatagcaggaccaggtcttttgttgataagtactgtttgtttattaatatgtcattaatggtatttcttttttacactctacaagtgaattagggagtctcttgttgacccctttgttgcaggaatgtgcgtcgggctaggttatccatgagtttctttattcctaatgcagttagaaagacctttctccttgagctctttgactcccagaaggtaccccagtccccagtgtacttagaaaggatctcgaacattgctggacgtcctcatagtactcacaaagggctagccttgaatgtcactcgcccagtcttcagtctcctgacttagagatacaatcacgtcacaggtctcttggcctcaatctgaaaactgctgccgccgcgccgaggagactcgcatgccgccaccacctcactgggagggcgccgagcccaccgtcgccccctagaccctgacagctgcagctgccttgccttgccgccgcctccctgcagggcccctgttccaatgaaaaacagaacacaaaagagcagagcacctaagcctgtctctgcctccctgtctaccggactggccagggcccaagacccccgctgctccactgcggggctgggcgggctgactccctgcttcctccaagctgctgcctcccctgcagccagggtctgggcagggtgcagccggtcctcggggcacgcagcttccttcaagtacactgtgtgtgcttcccggacctgcggcgatgccacgggcctgccttttctatgcgcctcactagcttaccaccctgtgcaggtaatgcaactgactttgtctcatcagtctttttctttccctgccaccctttatttatcaagcgtaatgttacactttaaaggacagcaaataagaactttgtagaatcccaccaggactttgctaacaataatgtttggaaataaagaagtgctctgaaaaaatatcagccaccaaaatagttatgttggcactgtgttcacacgcatggtccccacacccccaggttgggtgggtttttttgttttttgggtttttttggggggggggctttttcatgttacatccatatctgtatttatatcttatttgtttcactttcaagtgtatcatggcaaatgtacagatttttttgttaataatgtgctaggatttgctaaaaaagaaaacaaaaaaaacccttttgagtttgccctagaataaatgagacttaattca

SEQ ID NO: 454541 - DNA, 8597 bp, Homo sapiens
ttttttttaatccccgcaccaagcgcttaacctcattggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttaggtaaccttcagcgaacaaagagggcaacctcccagatacgtctgctggggagggagtcatcgtgactgccctctaggcttttgctgggatctgggatttgaattcccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtggttctgctgggcatggacatcctgtccgccctggtgacccggctgcaggatcggttcaaggcgcagatcggcacagtgctgccaagtctaatagacagactaggagatgctaaagactctgtgagggagcaggaccaaactctgctgctaaagatcatggatcaagctgctaatccccagtacgtatgggacagaatgcttggaggcttcaaacacaagaatttccgtactcgagaaggcatctgtctctgccttatagcaacactcaatgcctctggagcacagactttaacactaagcaagattgtgccacatatatgcaacttacttggagatccaaacagccaggttcgagatgcagcaataaacagcttagtggaaatttacagacatgtaggagaacgtgtgagggcagatctcagtaaaaaaggattgccacagtcccggttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttaggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagcacggagcagccgtatccctcgacccagcatgagtcaggggtgcagccgcgataccagccgtgagagcagccgagatacaagccctgctcggggctttcctccacttgatcggtttgggcttggccagccaggaagaatacctggttctgtgaatgccatgagagttctgagcacaagtacagatcttgaagctgctgttgctgatgctttgaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaagagagttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtggtgagtgctttggtcacgattggtgcctatgtgatgtccatgacctctgcgtagcccttatctagaacctactctaatagaataccccgtttccttgtcctctttcaggaaatgtcgagcatcctgaggatggggccatcttaagccccagtgaatgaatgaatctgatatttaagtatgccgttttttctcaggttgttcagtcaactacattttcactaggttatccagttagtcattcattcactgagttggtcttatttttcaacactggaaagatgcaagtgctcaattttgtctgtcactctagcacacccaacatcaatcatttgactccaggagtgcttgtatgatgattattcatttttggtttatatacacttaaaattggccttatgattctaagggaaaaaaaaaaccatcctgggcagattctacccatttatttacatgtgggttaaaagaccaaggaaagaatagaatatattctatatacagcccttgaataacgatgcctattctgcttcaccccagggctctccaagcaatacgattggccggacgccctcccgacacaccagcagcaggaccagccccctgacctcacccaccaactgttcccatgggggtctgtctccaagtcggttatggggttggagtgccgacgggttagcgaagcacccacctcccttttctcagcctaactccatccccaccgctccctcccacaaggctctcaggcgctcttactctcccagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtcccttccagcttttctgtagaatcttactggtattgaatgtaaaggaagcaaggcctgtattgcagtcttcatacaaaacaaaaggaataagaacagaaaagagccatactgaaacatgtcttgtacagcctgctgagatggcgaaaccctgtgtgtggggtgcagtttttaaaaatcagagcgctctagccactacttggtagaaagtagcattttttttttcagttaataacatatttgggggtggggtggggtgttactttgtgttcttcctccttagcctattttcttgtgcgtatggtctgtgtggggcccctttcacagctgacaccacgaaaggtgatatatctttaagttgtgttctgagacctactaaaaatgggaatcaagtcttggcaagaacagtctgaagatggccttttaacaaacgctgggaattttgcttgtcatatccagactggaggccgactgccctggctttcagcgtagaattgggagtgcaccctgacagtctccttccagctctccctaatcgactccaccgacaaggtccctaccccagagcttccatgcaaaggaattcttcaagtttaaatctggacacaaaaataagataaatgtatggcatcatttagggatgcctgagatggcagttcatgaagcacagaagataaagaagaagtctttcatctttactgctgagatccttgggaacactgttgtcatgggggctctgccaagaccctcatctctgggctacacggtgattcagattgagcaccaacttgtttcctcccctcaaagttctgcctaagccgttcagttctaacatggtctcagttaatctggtaaatggcatctttaccatcttagttctgacttctcagtttaatgtgggattaagagccaagaaaagcctagagagactggatatcacaattttttttaattttataaactgaagtagttccttgaatgtctgttgatgaaatagtcactgtttaaggaaaaaagtaattatgaggtgtagcagattgcagaaaaacaggattagaaacacacttaaaaagaacacacatttagagtctctcttcctcctcagcgaaccactaggccccctttttaaaaacacctttagagcctaattactccaataaaagtaactagaggtttggagtctggttaaataaattctgagtaaaattcttaagccaaatggaaattcttaatgcaatcatgaggacttctattgtctcttactgttgtattagatcctataaattgaactgatttttccataaggaaaatgcttcttttgagattaattctaataacgtatttgctattgcagtgcagagcccactgcaactgctaggactgaaagcagaggctgggtgccagagcacgtgattcttaacatcatttccacagacccctctgccctgaccctctgcattggatgcaggaagctgggaaagactgatgttgatttggaaacatgggctgaaaatgaaggccccatagtgcataggaacagtaaagccagggtgctgacgtgtgtgtgtgtgtgtgtgtgtgtgtgtgtgtgtgtgtgtgttgtgtgtgtttgtgcgtgcaccctacacatgtgtggtacctcactgctgctgtttagggaacttgagggacgcgtttcaaggggttgggtattactgacgagctttggctcaaaatatagcaggaccaggtcttttgttgataagtactgtttgtttattaatatgtcattaatggtatttcttttttacactctacaagtgaattagggagtctcttgttgacccctttgttgcaggaatgtgcgtcgggctaggttatccatgagtttctttattcctaatgcagttagaaagacctttctccttgagctctttgactcccagaaggtaccccagtccccagtgtacttagaaaggatctcgaacattgctggacgtcctcatagtactcacaaagggctagccttgaatgtcactcgcccagtcttcagtctcctgacttagagatacaatcacgtcacaggtctcttggcctcaatctgaaaactgctgccgccgcgccgaggagactcgcatgccgccaccacctcactgggagggcgccgagcccaccgtcgccccctagaccctgacagctgcagctgccttgccttgccgccgcctccctgcagggcccctgttccaatgaaaaacagaacacaaaagagcagagcacctaagcctgtctctgcctccctgtctaccggactggccagggcccaagacccccgctgctccactgcggggctgggcgggctgactccctgcttcctccaagctgctgcctcccctgcagccagggtctgggcagggtgcagccggtcctcggggcacgcagcttccttcaagtacactgtgtgtgcttcccggacctgcggcgatgccacgggcctgccttttctatgcgcctcactagcttaccaccctgtgcaggtaatgcaactgactttgtctcatcagtctttttctttccctgccaccctttatttatcaagcgtaatgttacactttaaaggacagcaaataagaactttgtagaatcccaccaggactttgctaacaataatgtttggaaataaagaagtgctctgaaaaaatatcagccaccaaaatagttatgttggcactgtgttcacacgcatggtccccacacccccaggttgggtgggtttttttgttttttgggtttttttggggggggggctttttcatgttacatccatatctgtatttatatcttatttgtttcactttcaagtgtatcatggcaaatgtacagatttttttgttaataatgtgctaggatttgctaaaaaagaaaacaaaaaaaacccttttgagtttgccctagaataaatgagacttaattca

SEQ ID NO: 454542 - DNA, 7330 bp, Homo sapiens
tcaagttcaacgtgggcaaggtagtgagatcctgcctctagaaaacaaacaaaaagctccacagactagttggaaatgtttttttttaaaaaaaaaaacaacaaaacttttgggctaagaactatttgccaagttcttaacatgcacatcggaaatctcagacccttgtcctttctagataactttaaatgaaggctctagatgttaagtggtttatatgcttcactgtctctaagaaaaataactatagtccagtatccttttcttgttttaggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttaggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagcacggagcagccgtatccctcgacccagcatgagtcaggggtgcagccgcgataccagccgtgagagcagccgagatacaagccctgctcggggctttcctccacttgatcggtttgggcttggccagccaggaagaatacctggttctgtgaatgccatgagagttctgagcacaagtacagatcttgaagctgctgttgctgatgctttgaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaagagagttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtggtgagtgctttggtcacgattggtgcctatgtgatgtccatgacctctgcgtagcccttatctagaacctactctaatagaataccccgtttccttgtcctctttcaggaaatgtcgagcatcctgaggatggggccatcttaagccccagtgaatgaatgaatctgatatttaagtatgccgttttttctcaggttgttcagtcaactacattttcactaggttatccagttagtcattcattcactgagttggtcttatttttcaacactggaaagatgcaagtgctcaattttgtctgtcactctagcacacccaacatcaatcatttgactccaggagtgcttgtatgatgattattcatttttggtttatatacacttaaaattggccttatgattctaagggaaaaaaaaaaccatcctgggcagattctacccatttatttacatgtgggttaaaagaccaaggaaagaatagaatatattctatatacagcccttgaataacgatgcctattctgcttcaccccagggctctccaagcaatacgattggccggacgccctcccgacacaccagcagcaggaccagccccctgacctcacccaccaactgttcccatgggggtctgtctccaagtcggttatggggttggagtgccgacgggttagcgaagcacccacctcccttttctcagcctaactccatccccaccgctccctcccacaaggctctcaggcgctcttactctcccagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtcccttccagcttttctgtagaatcttactggtattgaatgtaaaggaagcaaggcctgtattgcagtcttcatacaaaacaaaaggaataagaacagaaaagagccatactgaaacatgtcttgtacagcctgctgagatggcgaaaccctgtgtgtggggtgcagtttttaaaaatcagagcgctctagccactacttggtagaaagtagcattttttttttcagttaataacatatttgggggtggggtggggtgttactttgtgttcttcctccttagcctattttcttgtgcgtatggtctgtgtggggcccctttcacagctgacaccacgaaaggtgatatatctttaagttgtgttctgagacctactaaaaatgggaatcaagtcttggcaagaacagtctgaagatggccttttaacaaacgctgggaattttgcttgtcatatccagactggaggccgactgccctggctttcagcgtagaattgggagtgcaccctgacagtctccttccagctctccctaatcgactccaccgacaaggtccctaccccagagcttccatgcaaaggaattcttcaagtttaaatctggacacaaaaataagataaatgtatggcatcatttagggatgcctgagatggcagttcatgaagcacagaagataaagaagaagtctttcatctttactgctgagatccttgggaacactgttgtcatgggggctctgccaagaccctcatctctgggctacacggtgattcagattgagcaccaacttgtttcctcccctcaaagttctgcctaagccgttcagttctaacatggtctcagttaatctggtaaatggcatctttaccatcttagttctgacttctcagtttaatgtgggattaagagccaagaaaagcctagagagactggatatcacaattttttttaattttataaactgaagtagttccttgaatgtctgttgatgaaatagtcactgtttaaggaaaaaagtaattatgaggtgtagcagattgcagaaaaacaggattagaaacacacttaaaaagaacacacatttagagtctctcttcctcctcagcgaaccactaggccccctttttaaaaacacctttagagcctaattactccaataaaagtaactagaggtttggagtctggttaaataaattctgagtaaaattcttaagccaaatggaaattcttaatgcaatcatgaggacttctattgtctcttactgttgtattagatcctataaattgaactgatttttccataaggaaaatgcttcttttgagattaattctaataacgtatttgctattgcagtgcagagcccactgcaactgctaggactgaaagcagaggctgggtgccagagcacgtgattcttaacatcatttccacagacccctctgccctgaccctctgcattggatgcaggaagctgggaaagactgatgttgatttggaaacatgggctgaaaatgaaggccccatagtgcataggaacagtaaagccagggtgctgacgtgtgtgtgtgtgtgtgtgtgtgtgtgtgtgtgtgtgtgtgttgtgtgtgtttgtgcgtgcaccctacacatgtgtggtacctcactgctgctgtttagggaacttgagggacgcgtttcaaggggttgggtattactgacgagctttggctcaaaatatagcaggaccaggtcttttgttgataagtactgtttgtttattaatatgtcattaatggtatttcttttttacactctacaagtgaattagggagtctcttgttgacccctttgttgcaggaatgtgcgtcgggctaggttatccatgagtttctttattcctaatgcagttagaaagacctttctccttgagctctttgactcccagaaggtaccccagtccccagtgtacttagaaaggatctcgaacattgctggacgtcctcatagtactcacaaagggctagccttgaatgtcactcgcccagtcttcagtctcctgacttagagatacaatcacgtcacaggtctcttggcctcaatctgaaaactgctgccgccgcgccgaggagactcgcatgccgccaccacctcactgggagggcgccgagcccaccgtcgccccctagaccctgacagctgcagctgccttgccttgccgccgcctccctgcagggcccctgttccaatgaaaaacagaacacaaaagagcagagcacctaagcctgtctctgcctccctgtctaccggactggccagggcccaagacccccgctgctccactgcggggctgggcgggctgactccctgcttcctccaagctgctgcctcccctgcagccagggtctgggcagggtgcagccggtcctcggggcacgcagcttccttcaagtacactgtgtgtgcttcccggacctgcggcgatgccacgggcctgccttttctatgcgcctcactagcttaccaccctgtgcaggtaatgcaactgactttgtctcatcagtctttttctttccctgccaccctttatttatcaagcgtaatgttacactttaaaggacagcaaataagaactttgtagaatcccaccaggactttgctaacaataatgtttggaaataaagaagtgctctgaaaaaatatcagccaccaaaatagttatgttggcactgtgttcacacgcatggtccccacacccccaggttgggtgggtttttttgttttttgggtttttttggggggggggctttttcatgttacatccatatctgtatttatatcttatttgtttcactttcaagtgtatcatggcaaatgtacagatttttttgttaataatgtgctaggatttgctaaaaaagaaaacaaaaaaaacccttttgagtttgccctagaataaatgagacttaattca

SEQ ID NO: 454543 - DNA, 5564 bp, Homo sapiens
ttttttttaatccccgcaccaagcgcttaacctcattggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttaggtaaccttcagcgaacaaagagggcaacctcccagatacgtctgctggggagggagtcatcgtgactgccctctaggcttttgctgggatctgggatttgaattcccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtggttctgctgggcatggacatcctgtccgccctggtgacccggctgcaggatcggttcaaggcgcagatcggcacagtgctgccaagtctaatagacagactaggagatgctaaagactctgtgagggagcaggaccaaactctgctgctaaagatcatggatcaagctgctaatccccagtacgtatgggacagaatgcttggaggcttcaaacacaagaatttccgtactcgagaaggcatctgtctctgccttatagcaacactcaatgcctctggagcacagactttaacactaagcaagattgtgccacatatatgcaacttacttggagatccaaacagccaggttcgagatgcagcaataaacagcttagtggaaatttacagacatgtaggagaacgtgtgagggcagatctcagtaaaaaaggattgccacagtcccggttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttaggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagcacggagcagccgtatccctcgacccagcatgagtcaggggtgcagccgcgataccagccgtgagagcagccgagatacaagccctgctcggggctttcctccacttgatcggtttgggcttggccagccaggaagaatacctggttctgtgaatgccatgagagttctgagcacaagtacagatcttgaagctgctgttgctgatgctttgaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaagagagttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtggtgagtgctttggtcacgattggtgcctatgtgatgtccatgacctctgcgtagcccttatctagaacctactctaatagaataccccgtttccttgtcctctttcaggaaatgtcgagcatcctgaggatggggccatcttaagccccagtgaatgaatgaatctgatatttaagtatgccgttttttctcaggttgttcagtcaactacattttcactaggttatccagttagtcattcattcactgagttggtcttatttttcaacactggaaagatgcaagtgctcaattttgtctgtcactctagcacacccaacatcaatcatttgactccaggagtgcttgtatgatgattattcatttttggtttatatacacttaaaattggccttatgattctaagggaaaaaaaaaaccatcctgggcagattctacccatttatttacatgtgggttaaaagaccaaggaaagaatagaatatattctatatacagcccttgaataacgatgcctattctgcttcaccccagggctctccaagcaatacgattggccggacgccctcccgacacaccagcagcaggaccagccccctgacctcacccaccaactgttcccatgggggtctgtctccaagtcggttatggggttggagtgccgacgggttagcgaagcacccacctcccttttctcagcctaactccatccccaccgctccctcccacaaggctctcaggcgctcttactctcccagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagcaccaccaggacagcagcaccaccaggacagcagcaccaccgacggtaccgc

SEQ ID NO: 454544 - DNA, 493 bp, Homo sapiens
gttatagacatgatgtatgtaataactttaatactattagtatgttacaaaacttaagacagttgctgtcgtactgtctacgatagtttaggaataaaagaccgattaaaactgaactttgtaagacacctatactccctgaagtatttctagtcaatttgcagccccaagggaccaaaataaaccaaattgtggggatggtagtgggtcttttaaactttgagatgtcattgtatctgtgtctgaaaacaataattctttaaaataggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggtaaatatttctagaacaatgttaagtattttttgatcattagtattctcggttggctgttatgtatagaagccttcgtgaagggtt

SEQ ID NO: 454545 - DNA, 3961 bp, Homo sapiens
taagccgagtaggcggactggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactgtggtctaatgtttgtgagaagcttctaattagatcaattacttattttaggaaatttaagactagatactcgtgtgtggggtgaggggagggagtatttggtatgttgggataaggaaacacttctatttaatgcttccagggatttttttttttttttttaaccctcctgggcccaagtgatccttccacctcagtctcccagctaattgagaccacaggcttgttaccaccatgctcggcttttgcattaatctaagaaaaggggagagaagttaatccacatctttactcaggcaaggggcatttcacagtgcccaagagtggggttttcttgaacatacttggtttcctatttccccttatctttctaaaactgcctttctggtggctttttttaaaattattactaatgatgcttttatagctgcttggattctctgagaaatgatggggagtgagtgatcactggtattaactttatacacttggatttcatttgtaactttaggatgtaaaggtatattgtgaaccctagctgtgtcagaatctccatccctgaaatttctcattagtggtactggggtgggatcttggatggtgacattgaaactacactaaatcccctcactatgaatgggttgttaaaggcaatggtttgtgtcaaaactggtttaggattacttagattgtgttcctgaagaaaagagtccaggtaaatggtatgatcaataaaggacaggctggtgctaacataaaatccaatattgtaatcctagcactttgggaggccaaggcgggtggatcacaaggtcaagagatagagaccatctttgccaacatggtgaaactccatctctactgaaaatacaaaaattagctgggcgtggtagtgcaagctgaaggctgaggcaggagaatcactcgaacctgggaggcagaggttgcagtgagccgagatcacaccactgtactccagcccggcactccagcctggcgacaagagtgagactccacctcaaaaaaaaaaaaaaagaatccaatactgcccaaggataggtattttatagatgggcaactggctgaaaggttaattctctagggctagtagaactggatcccaacaccaaactcttaattagacctaggcctcagctgcactgcccgaaaagcatttgggcagaccctgagcagaatactggtctcaggccaagcccaatacagccattaaagatgacctacagtgctgtgtaccctggggcaatagggttaaatggtagttagcaactagggctagtcttcccttacctcaaaggctctcactaccgtggaccacctagtctgtaactctttctgaggagctgttactgaatattaaaaagatagacttcaactatgtgtc

SEQ ID NO: 454546 - DNA, 3209 bp, Homo sapiens
taagccgagtaggcggactggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactgtaaaaaaaaaaaaaaaaaaaaaaaaaaaaaggggggggggtaaaaatttcccccggggggcccagtttagggttccccggtttttttgccccaagggggcccctatgggggtcgtataataggcagggcaggggccgtgttttaccacgcgtgcgtgcgggggagcacccggctcgctggggcccttgggggagggaacccctaaccttcggcgggggcccatattggcccccctcaccctacagagtttaagcggtcctcagggtcaatttacactctcacgtgttacggtctacccacgcgaattgctggcgtggaagtcggtcccaggtttgttctgagcatcttcaccacgggctgccgccacaaaacaacagggaacagaaaccaatagagccacggagaggaacaacgagaactatagagccaagaggtataccagaggcacaagccagtcaaaaggaccagggacatggagagaaacacattctttgcacgccagcagacagagacgagacagcaaagaacagaaaccacgaacccaacaggaaaccaatcaaaacacgcaagacctcagccgaacaaacagcatcttacaagagagatcactaccaactcagcagacgagacaaacacaagagacaaaccg

SEQ ID NO: 454547 - DNA, 2934 bp, Homo sapiens
taagccgagtaggcggactggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactgaaaaaaaaaaaaaaaaaaactcgagttttttttttttttttttttaagatggataagcaaaagcatttattggtcaatgtgatatgttacggttgaggcatacccaggataagaactaagcaatactaaatcagttattacccaatatttactcttggctcaccatgtacatcaaacatttataaatctcaatgtgcttctggaatttgaataaggattttggagcacctcaaggccaatctgtgattaatgagaactgttgagttacttggcttggtgtcacagctgcccactggtgaaaaggctggctttagtatctctactatagccagggattcccactttatcatggctgtctctctctgaggcacttc

SEQ ID NO: 454548 - DNA, 2613 bp, Homo sapiens
taagccgagtaggcggactggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactggcaaaagaaataaaagtagaggcaattagtaagcaaaagaataaagtagggac

SEQ ID NO: 454549 - DNA, 2841 bp, Homo sapiens
taagccgagtaggcggactggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtaggtcatcatcgcagcatctttcttagtgattcagtagcttgatggaagactcattagctattgctttagaaaataccagaatatgagcaacaaggtcacacagctagtaaagggtataagtgaagacaagactggggtagtctcaagatcattagcaactgtttaattcactgcctttaaaatgtgtgtgttagaacctaaccaaatgttagagagataaactttacatagctcatagggagaacttgaattaaaagttaaataacttatccttacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactg

SEQ ID NO: 454550 - DNA, 2730 bp, Homo sapiens
taagccgagtaggcggactggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttctcctaccccagtcgacaccgaataactgttgcgtctcttcacaaacgtagtatttcgttgtaccgcccacaaaccgtggggggcctgctttggcccaacgcgggtgctgggctcgcggagcggttatcgccggcgcgcgcatatttggcgccctgtggggcaatttggccctttgggggagctgctccaccgagcccagtggccccggggttcgccaccccgccgcccctgaaattagccgggccttgcgccacgttaattaagagtcga

SEQ ID NO: 454551 - DNA, 1783 bp, Homo sapiens
aattaggctagtacgaggctgggttgaattcggccgaggctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactg

SEQ ID NO: 454552 - DNA, 1736 bp, Homo sapiens
gccccccccttttggtggtgggcccccccttcgatcggctcgtacctcgtccgcatcagcaagaatgaaatgagtccttctatgaaggagagacttgtctgagagcctgactcgggccaaatttgaagagctcaacatggatctgttccggtctactatgaagcccgtccagaaagtgttggaagattctgatttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactg

SEQ ID NO: 454553 - DNA, 2598 bp, Homo sapiens
taagccgagtaggcggactggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatacacacaaatggaacagaaatagaaaataaacaacatgaagaaaaatagaaaagatagagaaaaaagaatagaaagaagaagaaaagaatagaaagaaagaaaaaaaaagaataaaggaagagaaatacgaataaatagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactg

SEQ ID NO: 454554 - DNA, 1359 bp, Homo sapiens
atcaatatcagacttcttcaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactg

SEQ ID NO: 454555 - DNA, 1145 bp, Homo sapiens
cacgcgtccggtgacctggtactgcttgatgtatgtccccttacacttggtatcgaaactgtgggaggtgtcatgaccaaactcgaattccaaagattcagcaactggttaaagagttcttcaatggcaaggaaccatcccgtggcataaacccagatgaagctgtagcgtatggtgctgctgtccaggctggtgtgtaatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactg

SEQ ID NO: 454556 - DNA, 897 bp, Homo sapiens
ctgtcactcgaagaataccattcacatctatctcaaaggtgacttcaatctgtgggaccccacgaggagcaggaggaattccagtcagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactg

SEQ ID NO: 454557 - DNA, 790 bp, Homo sapiens
taatatttcgcccactaagccaatcactttattgactcaggtggtgtgcacaccacctggaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactg

SEQ ID NO: 454558 - DNA, 2039 bp, Homo sapiens
taagccgagtaggcggactggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatagatatggtggtctttaatgaggtaccagtcgaaccaaaatcgtgaataactgggagccaatcatctggcatgtaatagattacgttgct

SEQ ID NO: 454559 - DNA, 1994 bp, Homo sapiens
taagccgagtaggcggactggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtaggtcatcatcgcagcatctttcttagtgattcagtagcttgatggaagactcattagctattgctttagaaaataccagaatatgagcaacaaggtcacacagctagtaaagggtataagtgaagacaagactggggtagtctcaagatcattagcaactgtttaattcactgcctttaaaatgtgtgtgttagaacctaaccaaatgttagagagataaactttacatagctcatagggagaacttgaattaaaagttaaataacttatccttacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtaattacttaagtttgttaatatcatggctttttttttgagactctgtctcaaacaaaaaaaaaa

SEQ ID NO: 454560 - DNA, 910 bp, Homo sapiens
ccggtcactgtcgtacgtattactcactcctctgcttaaaatgttcccccagttcttctcatggctacttgcttctcatccgtggaggcttcagctcaaatacctccccaaaccctcatttaaatatgctcctccctgcttagaagaaaaaactaagaagaaatacttaaactactttaaaaaatattgttcagttaattgaaggaaatcagtaaaaccagccattggggctactataatgaattggtatggtattggtacagaaagaggccaccagaacagagtaggaagtccaaaaccagtcatgttacatggatatttaatatacattgaaggtgccacttcaggtctgtggggaatattttaagcagaggagtgagtaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactg

SEQ ID NO: 454561 - DNA, 489 bp, Homo sapiens
gccccccccttttggtggtgggcccccccttcgatcggctcgtacctcgtccgcatcagcaagaatgaaatgagtccttctatgaaggagagacttgtctgagagcctgactcgggccaaatttgaagagctcaacatggatctgttccggtctactatgaagcccgtccagaaagtgttggaagattctgatttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactg

SEQ ID NO: 454562 - DNA, 2560 bp, Homo sapiens
taagccgagtaggcggactggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactg

SEQ ID NO: 454563 - DNA, 3013 bp, Homo sapiens
taagccgagtaggcggactggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaataaaaaaagaaaaaaactgacaagaaagagaacaaaaagtagaaaagaaaacgagaagggacggggggacgcggcatactacctgccggtggagtagataactaaagattatgaatgacacgagaatccataggtatctttatagaaatcaagaagatgagtagaagagaagccgtatatgtgtggatatactaatataataaacatgaggcgatagtgtagcactttaaataaaaaaacaacagatacagacggaacgaaacaatacagcggtgtcgtaagaatgatctacagaaaaaaaactaaagttatggagagaaaagacagaaaaggcggaaacaacagagaa

SEQ ID NO: 454564 - DNA, 2964 bp, Homo sapiens
taagccgagtaggcggactggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactgaaaaaaaaaaaaaaaaaaaaaaaaaaaaaaaaaaaaaaaaaaaaaaaaaagaaaataaaaaaagaaaaaaactgacaagaaagagaacaaaaagtagaaaagaaaacgagaagggacggggggacgcggcatactacctgccggtggagtagataactaaagattatgaatgacacgagaatccataggtatctttatagaaatcaagaagatgagtagaagagaagccgtatatgtgtggatatactaatataataaacatgaggcgatagtgtagcactttaaataaaaaaacaacagatacagacggaacgaaacaatacagcggtgtcgtaagaatgatctacagaaaaaaaactaaagttatggagagaaaagacagaaaaggcggaaacaacagagaa

SEQ ID NO: 454565 - DNA, 2673 bp, Homo sapiens
taagccgagtaggcggactggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggtatgttccttgttttctgctttgctaatgagatctccttagactctgaattcaggacattgcatctagatacttagataacagacatcacagtaaccatgtcttttttctaggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactg

SEQ ID NO: 454566 - DNA, 2016 bp, Homo sapiens
tttaattttcagtagagacagggtttctccacattgcccaggctggtcttgaaatcctgccctcaggtgatcctcctgcctcagcctcccaaagtgctgggattataggcagaagccaccgcctggccagactgtaatttaaataagggttaaactatgtgacaatacacttaattatcttttatccttttaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactg

SEQ ID NO: 454567 - DNA, 1798 bp, Homo sapiens
taagccgagtaggcggactggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctaatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactg

SEQ ID NO: 454568 - DNA, 2261 bp, Homo sapiens
taagccgagtaggcggactggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagttttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactg

SEQ ID NO: 454569 - DNA, 1458 bp, Homo sapiens
gccccccccttttggtggtgggcccccccttcgatcggctcgtacctcgtccgcatcagcaagaatgaaatgagtccttctatgaaggagagacttgtctgagagcctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactg

SEQ ID NO: 454570 - DNA, 2216 bp, Homo sapiens
taagccgagtaggcggactggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaactccaccaccaccaccaccac

SEQ ID NO: 454571 - DNA, 784 bp, Homo sapiens
ttaaataacaaacatttattggtgtcacttatggtagaaaaaacttcctacacgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactg

SEQ ID NO: 454572 - DNA, 1696 bp, Homo sapiens
taagccgagtaggcggactggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagaccttgattgtaacagttggcggccgca

SEQ ID NO: 454573 - DNA, 559 bp, Homo sapiens
  misc_feature (24)..(24): n is a, c, g, or t
aagctgattctggcggatcccttnacgacgaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactg

SEQ ID NO: 454574 - DNA, 963 bp, Homo sapiens
gcaatggcatgatctgggctcactgcaacctccgcctcccgggttcaagcgattctcctgcctcagcctcctgagtagctgggatgcatgtgccaccatttctccatgttggtcaggctggtcttgaactcccgacctcaggtgatctgcctgccttggcctcccaaagcactggcattacaggtgtgagccaccgcgcccagccctgttactcttgagtttttatctccacatacttgaattaaactgtgtagttctttttcccatctgatatttacaatctcttcactgggtcatactccacagctattttaccactttctgaaataaagttagcaaggatcaattcagaatctttttcattctaaaacttcctgcatatactggtcgcaccccacaatgagacattcttttggtttctaaaagcagaaaataagatgtgatgattaaatgaaataatggccagatcttggttcacattccacacaacagggaaccacgactctagggaatgtggctgattcccaggctgtagcaggaaagggttatgagatcagtctggattcttgttgtaccagaaattttaaaaatgctcaaagtatggattggggcatgtcaaatggacacaagagctagctcaaagaggcactgactggccagatcttggacaatattttttggtaacagctttattgagatataattcatgtatcatagaattaattccattaacgtgtacaattcaatggtttttagtatatttgcagagttatgcaactaccacctcactcagttttagaatattttcaccaatctaaaacaaaaccccatttagcagttactgcccaccccgctcctcccaatgcctggcaaccactagtctactttctgtctctatggatttgcctactctggacatttcatatacatggagttacataaaacatggcattttgtatctgg

SEQ ID NO: 454575 - DNA, 2473 bp, Homo sapiens
  misc_feature (2201)..(2201): n is a, c, g, or t
  misc_feature (2208)..(2208): n is a, c, g, or t
  misc_feature (2240)..(2240): n is a, c, g, or t
  misc_feature (2257)..(2257): n is a, c, g, or t
  misc_feature (2268)..(2268): n is a, c, g, or t
  misc_feature (2270)..(2270): n is a, c, g, or t
  misc_feature (2274)..(2274): n is a, c, g, or t
  misc_feature (2301)..(2301): n is a, c, g, or t
  misc_feature (2328)..(2328): n is a, c, g, or t
  misc_feature (2334)..(2334): n is a, c, g, or t
  misc_feature (2342)..(2343): n is a, c, g, or t
  misc_feature (2358)..(2358): n is a, c, g, or t
  misc_feature (2364)..(2364): n is a, c, g, or t
  misc_feature (2366)..(2366): n is a, c, g, or t
  misc_feature (2373)..(2373): n is a, c, g, or t
  misc_feature (2380)..(2380): n is a, c, g, or t
  misc_feature (2390)..(2390): n is a, c, g, or t
  misc_feature (2399)..(2399): n is a, c, g, or t
  misc_feature (2410)..(2410): n is a, c, g, or t
  misc_feature (2423)..(2423): n is a, c, g, or t
  misc_feature (2429)..(2429): n is a, c, g, or t
  misc_feature (2452)..(2452): n is a, c, g, or t
  misc_feature (2456)..(2456): n is a, c, g, or t
  misc_feature (2460)..(2460): n is a, c, g, or t
  misc_feature (2470)..(2470): n is a, c, g, or t
gacgtgggccccgagtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgggcagatccacagtccgcttttcgtggccggagcgcaccctccgcaaaggcaggccacatccggccgcccctggaacgccaggcgtccggctatccggcccggcagccctcccctccgcgcagcctgtccggactggcagcgagggcttggggaggagaggaaggagagggcgcggccgggagtctcgcagcgtccgccctcccgggccgggcggatggctggaaggtggagccccgcccgtcacttggcgccgagccccagcgccaggggctaaggcgatggcccctgggcccaccgctccccagatcggggatgcaggggaccgcgccctgcccctccgccccgtcattgacctgcgcgaaggcttcacccagggcaggctacctggcttctgagcagccgcagcatcattgcgtggaccaggagacggagcgcccagttgcaatgctggagccgggaggtccaatccgccgccctctctcttccggtgccagggcttagagtcggcccccgacacctgggtgcttcgagcctggccacgccccagcggctgggcagggcccccgcacctggtcccggcgagtggagcgatcgtccgccctctgccgcgtcctcctgggggacggagaacctgtttgccaggctgccgccggagcgcgcgagggcctccagcctgcaggtgctcccgcgcccaccagggtctccgatctcccacaccccccgcctcaccgtccacactcaaattccagaatcccagcccctagtcactccttttggggaattctagggtcccgtgccaaactgctactttcagacctgcactgcacgaaggcaaccattccaaggctggagaccggagtggaacagggtctgtttcccacgccgtcagcgggggccgtggctgccggctccagagacaaaggcctctgcccgcttgtcacctaattaaagcattttctctggtccaaggcccacctccagcatcgccaaccccgagcagggcaggctaacgtagggtccagctacggggctttgcgggtgggtgttcttccccctgtgaggagaggaaggagagattgtaagaaataaagacacaagacaaagagataaagagaaaacagctgggcccgggggaccactaccatcaagacgcagagaccggtagtggccccgaatggctgggcgcgctgatatttattgtatacaagacaagggggggcaggataaggagggtgagtcgtccaaatgactgataaggtcaagcaagtcacgtgatcatgggacagggggcccttcccttttaggcagccgaagcagaaagagaaggcagcatatgtcagcgttttcttctctgcacttataagaaagatcaaagactttaagactttcactatttcgggcgggcncggtggntcacgcctgtaatcccagcactttgggaggcngaggcgggcggatcacnaggtcaggagntngagnccatcctggctaacacggtgaaacccngtctctactaaaaatacaaaaaattanccgggngtggtggnnggcgcctgtagtccnagctantngggaggntgaggcnggagaatggngtgaacccnggaggcggagnttgcagtgagccnagatcncgccactgcactccagcctgggngacngagngagactccgnctc

SEQ ID NO: 454576 - DNA, 586 bp, Homo sapiens
cacgtgccaccacggcagactaattttattttatttttgggaagagacaaagtcttgttatgttggcctggctggtctcaaactcagggtgcaagcgatcctcccgcctcagccttccaaactgctgggattacaggcgtgggccaccgtacccagcctccttgaagtttttctgacctgcaactcccctacctgcccattggagagggcgtcacaggggaggggttcaggctcacatgtggttggagctgcctctccaggtgcttttctgctaggtccctggcagggggtcttcctgcccggagcagcgtggccaggccctcaggaccctctgggactggcatcagcacgtgacctctccttatccacttgtgtgtctagatctcctcagtggccgcctctactgggttgactccaaacttcactccatctcaagcatcgatgtcaatgggggcaaccggaagaccatcttggaggatgaaaagaggctggcccaccccttctccttggccgtctttgaggtgtggcttacgtacgagatgcaagcacttaggtggcggatagacacagactatagatcactcaa

SEQ ID NO: 454577 - DNA, 351 bp, Homo sapiens
gctcagacacacctgaccttcctccttcctctctctggctctcacagtgacactctgcgagggacccaacaagttcaagtgtcacagcggcgaatgcatcaccctggacaaagtctgcaacatggctagagactgccgggactggtcagatgaacccatcaaagagtgcggtgagtctcggtgcaggcggcttgcagagtttgtggggagccaggaaagggactgagacatgagtgctgtagggttttgggaactccactctgcccaccctgtgcaaagggctccttttttcattttgagacagtctgggcaacaagagtgaaactccatccaaaaaaaaaagaaaagaaa

SEQ ID NO: 454578 - DNA, 5261 bp, Homo sapiens
gacgtgggccccgagtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagggacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaatgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggtcctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccggcctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgccacggagctgggtctctggtctcgggggcagctgtgtgacagagcgtgcctctccctacagtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaagggcaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcaccggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgtacatttggcatttgtgttattattttgcactgttttctgtcgtgtgtgttgggatgggatcccaggccagggaaagcccgtgtcaatgaatgccggggacagagaggggcaggttgaccgggacttcaaagccgtgatcgtgaatatcgagaactgccattgtcgtctttatgtccgcccacctagtgcttccacttctatgcaaatgcctccaagccattcacttccccaatcttgtcgttgatgggtatgtgtttaaaacatgcacggtgaggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggtgtgaacccgggaagcggagcttgcagtgagccgagattgcgccactgcagtccgcagtctggcctgggcgacagagcgagactccgtctcaaaaaaaaaaaacaaaaaaaaaccatgcatggtgcatcagcagcccatggcctctggccaggcatggcgaggctgaggtgggaggatggtttgagctcaggcatttgaggctgtcgtgagctatgattatgccactgctttccagcctgggcaacatagtaagaccccatctcttaaaaaatgaatttggccagacacaggtgcctcacgcctgtaatcccagcactttgggaggctgagctggatcacttgagttcaggagttggagaccaggcctgagcaacaaagcgagatcccatctctacaaaaaccaaaaagttaaaaatcagctgggtacggtggcacgtgcctgtgatcccagctacttgggaggctgaggcaggaggatcgcctgagcccaggaggtggaggttgcagtgagccatgatcgagccactgcactccagcctgggcaacagatgaagaccctatttcagaaatacaactataaaaaaataaataaatcctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaattaaatttcttaaatgaaccaaaaaaaaaaaactc

SEQ ID NO: 454579 - DNA, 4867 bp, Homo sapiens
aaatatccggcgcatcatctgtccgaccagacgtacggcccaagcaggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagggacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaatgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggtcctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccggcctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaagggcaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcaccggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgtacatttggcatttgtgttattattttgcactgttttctgtcgtgtgtgttgggatgggatcccaggccagggaaagcccgtgtcaatgaatgccggggacagagaggggcaggttgaccgggacttcaaagccgtgatcgtgaatatcgagaactgccattgtcgtctttatgtccgcccacctagtgcttccacttctatgcaaatgcctccaagccattcacttccccaatcttgtcgttgatgggtatgtgtttaaaacatgcacggtgaggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggtgtgaacccgggaagcggagcttgcagtgagccgagattgcgccactgcagtccgcagtctggcctgggcgacagagcgagactccgtctcaaaaaaaaaaaacaaaaaaaaaccatgcatggtgcatcagcagcccatggcctctggccaggcatggcgaggctgaggtgggaggatggtttgagctcaggcatttgaggctgtcgtgagctatgattatgccactgctttccagcctgggcaacatagtaagaccccatctcttaaaaaatgaatttggccagacacaggtgcctcacgcctgtaatcccagcactttgggaggctgagctggatcacttgagttcaggagttggagaccaggcctgagcaacaaagcgagatcccatctctacaaaaaccaaaaagttaaaaatcagctgggtacggtggcacgtgcctgtgatcccagctacttgggaggctgaggcaggaggatcgcctgagcccaggaggtggaggttgcagtgagccatgatcgagccactgcactccagcctgggcaacagatgaagaccctatttcagaaatacaactataaaaaaataaataaatcctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaattaaatttcttaaatgaaccaaaaaaaaaaaactc

SEQ ID NO: 454580 - DNA, 5059 bp, Homo sapiens
gacgtgggccccgagtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagggacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctaggacaaagtattttggacagatatcatcaacgaagccattttcagtgccaaccgcctcacaggttccgatgtcaacttgttggctgaaaacctactgtccccagaggatatggtcctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccggcctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaagggcaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcaccggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgtacatttggcatttgtgttattattttgcactgttttctgtcgtgtgtgttgggatgggatcccaggccagggaaagcccgtgtcaatgaatgccggggacagagaggggcaggttgaccgggacttcaaagccgtgatcgtgaatatcgagaactgccattgtcgtctttatgtccgcccacctagtgcttccacttctatgcaaatgcctccaagccattcacttccccaatcttgtcgttgatgggtatgtgtttaaaacatgcacggtgaggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggtgtgaacccgggaagcggagcttgcagtgagccgagattgcgccactgcagtccgcagtctggcctgggcgacagagcgagactccgtctcaaaaaaaaaaaacaaaaaaaaaccatgcatggtgcatcagcagcccatggcctctggccaggcatggcgaggctgaggtgggaggatggtttgagctcaggcatttgaggctgtcgtgagctatgattatgccactgctttccagcctgggcaacatagtaagaccccatctcttaaaaaatgaatttggccagacacaggtgcctcacgcctgtaatcccagcactttgggaggctgagctggatcacttgagttcaggagttggagaccaggcctgagcaacaaagcgagatcccatctctacaaaaaccaaaaagttaaaaatcagctgggtacggtggcacgtgcctgtgatcccagctacttgggaggctgaggcaggaggatcgcctgagcccaggaggtggaggttgcagtgagccatgatcgagccactgcactccagcctgggcaacagatgaagaccctatttcagaaatacaactataaaaaaataaataaatcctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaattaaatttcttaaatgaaccaaaaaaaaaaaactc

SEQ ID NO: 454581 - DNA, 3775 bp, Homo sapiens
cacgtgccaccacggcagactaattttattttatttttgggaagagacaaagtcttgttatgttggcctggctggtctcaaactcagggtgcaagcgatcctcccgcctcagccttccaaactgctgggattacaggcgtgggccaccgtacccagcctccttgaagtttttctgacctgcaactcccctacctgcccattggagagggcgtcacaggggaggggttcaggctcacatgtggttggagctgcctctccaggtgcttttctgctaggtccctggcagggggtcttcctgcccggagcagcgtggccaggccctcaggaccctctgggactggcatcagcacgtgacctctccttatccacttgtgtgtctagatctcctcagtggccgcctctactgggttgactccaaacttcactccatctcaagcatcgatgtcaatgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggtcctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccggcctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaagggcaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcaccggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgtacatttggcatttgtgttattattttgcactgttttctgtcgtgtgtgttgggatgggatcccaggccagggaaagcccgtgtcaatgaatgccggggacagagaggggcaggttgaccgggacttcaaagccgtgatcgtgaatatcgagaactgccattgtcgtctttatgtccgcccacctagtgcttccacttctatgcaaatgcctccaagccattcacttccccaatcttgtcgttgatgggtatgtgtttaaaacatgcacggtgaggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggtgtgaacccgggaagcggagcttgcagtgagccgagattgcgccactgcagtccgcagtctggcctgggcgacagagcgagactccgtctcaaaaaaaaaaaacaaaaaaaaaccatgcatggtgcatcagcagcccatggcctctggccaggcatggcgaggctgaggtgggaggatggtttgagctcaggcatttgaggctgtcgtgagctatgattatgccactgctttccagcctgggcaacatagtaagaccccatctcttaaaaaatgaatttggccagacacaggtgcctcacgcctgtaatcccagcactttgggaggctgagctggatcacttgagttcaggagttggagaccaggcctgagcaacaaagcgagatcccatctctacaaaaaccaaaaagttaaaaatcagctgggtacggtggcacgtgcctgtgatcccagctacttgggaggctgaggcaggaggatcgcctgagcccaggaggtggaggttgcagtgagccatgatcgagccactgcactccagcctgggcaacagatgaagaccctatttcagaaatacaactataaaaaaataaataaatcctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaattaaatttcttaaatgaaccaaaaaaaaaaaactc

SEQ ID NO: 454582 - DNA, 3540 bp, Homo sapiens
ggtttcaccatgttagccaggctggtcttgaactcctaacctcaggcgattcacctgcctcggcctcccaaagtgctgggattaaaggtatgagccacctcgcctggtgtgagccacctcgcccagcctgagccacctcacccagcctaagccactgtgcctggcctgattttggactttttaaaaattttattaataattatttttgggtttcttttttttgagacagggtcttactctgtcatccaggccatcctgtctgtctgtcatcccagtgatgggatcataccttgctgcagcctctacctcctgggctcaagcgatcctcccccctcagcctcctgagtagctgggagtacaggtgtgcaccaccacacctggctaatttttttttttttttttgtatatagagatggtattttgccatgttgaccaggctagtcttaaactcctggactcactcaagagatcctcctgccttggcctcccaaggtcatttgagactttcgtcattaggcgcacacctatgagaagggcctgcaggcacgtggcactcagaagacgtttatttattctttcagaggctgaggctgcagtggccacccaggagacatccaccgtcaggctaaaggtcagctccacagccgtaaggacacagcacacaaccacccggcctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaagggcaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcaccggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgtacatttggcatttgtgttattattttgcactgttttctgtcgtgtgtgttgggatgggatcccaggccagggaaagcccgtgtcaatgaatgccggggacagagaggggcaggttgaccgggacttcaaagccgtgatcgtgaatatcgagaactgccattgtcgtctttatgtccgcccacctagtgcttccacttctatgcaaatgcctccaagccattcacttccccaatcttgtcgttgatgggtatgtgtttaaaacatgcacggtgaggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggtgtgaacccgggaagcggagcttgcagtgagccgagattgcgccactgcagtccgcagtctggcctgggcgacagagcgagactccgtctcaaaaaaaaaaaacaaaaaaaaaccatgcatggtgcatcagcagcccatggcctctggccaggcatggcgaggctgaggtgggaggatggtttgagctcaggcatttgaggctgtcgtgagctatgattatgccactgctttccagcctgggcaacatagtaagaccccatctcttaaaaaatgaatttggccagacacaggtgcctcacgcctgtaatcccagcactttgggaggctgagctggatcacttgagttcaggagttggagaccaggcctgagcaacaaagcgagatcccatctctacaaaaaccaaaaagttaaaaatcagctgggtacggtggcacgtgcctgtgatcccagctacttgggaggctgaggcaggaggatcgcctgagcccaggaggtggaggttgcagtgagccatgatcgagccactgcactccagcctgggcaacagatgaagaccctatttcagaaatacaactataaaaaaataaataaatcctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaattaaatttcttaaatgaaccaaaaaaaaaaaactc

SEQ ID NO: 454583 - DNA, 3163 bp, Homo sapiens
tgtgcgtgtgttctggtctcatatttgtttgttttgagacagggtgtcgctctgtcactgagtctggagtgcagtggcgcaatcagagttcactgcagcctcaaactcttgggctcagttgattctcccacttcagcctcccaagtagctggaactacaggtgaacaccactgtgcccagctaatttattttatttttagtagagatgaggtctcactatgttgcccaggctggtctcgaactcttgacctcatgatccgcccgcctcagcctcccaaaatgctgggattacaggcgtgagccaccaggcccaggccgcaaggcgatctctaaacaaacataaaagaccaggagtcaaggttatggtacgatgcccgtgttttcactccagccacggagctgggtctctggtctcgggggcagctgtgtgacagagcgtgcctctccctacagtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaagggcaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcaccggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgtacatttggcatttgtgttattattttgcactgttttctgtcgtgtgtgttgggatgggatcccaggccagggaaagcccgtgtcaatgaatgccggggacagagaggggcaggttgaccgggacttcaaagccgtgatcgtgaatatcgagaactgccattgtcgtctttatgtccgcccacctagtgcttccacttctatgcaaatgcctccaagccattcacttccccaatcttgtcgttgatgggtatgtgtttaaaacatgcacggtgaggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggtgtgaacccgggaagcggagcttgcagtgagccgagattgcgccactgcagtccgcagtctggcctgggcgacagagcgagactccgtctcaaaaaaaaaaaacaaaaaaaaaccatgcatggtgcatcagcagcccatggcctctggccaggcatggcgaggctgaggtgggaggatggtttgagctcaggcatttgaggctgtcgtgagctatgattatgccactgctttccagcctgggcaacatagtaagaccccatctcttaaaaaatgaatttggccagacacaggtgcctcacgcctgtaatcccagcactttgggaggctgagctggatcacttgagttcaggagttggagaccaggcctgagcaacaaagcgagatcccatctctacaaaaaccaaaaagttaaaaatcagctgggtacggtggcacgtgcctgtgatcccagctacttgggaggctgaggcaggaggatcgcctgagcccaggaggtggaggttgcagtgagccatgatcgagccactgcactccagcctgggcaacagatgaagaccctatttcagaaatacaactataaaaaaataaataaatcctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaattaaatttcttaaatgaaccaaaaaaaaaaaactc

SEQ ID NO: 454584 - DNA, 3866 bp, Homo sapiens
gacgtgggccccgagtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagggacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaatgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggtcctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccggcctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctctactaaaaatacaaaaaattagccgggcgcggtggcgggcacctgtagtcccagctactcgggaggctgaggcaggagaatggtgtgaacccgggaagcggagcttgcagtgagccgagattgcgccactgcagtccgcagtctggcctgggcgacagagcgagactccgtctcaaaaaaaaaaaacaaaaaaaaaccatgcatggtgcatcagcagcccatggcctctggccaggcatggcgaggctgaggtgggaggatggtttgagctcaggcatttgaggctgtcgtgagctatgattatgccactgctttccagcctgggcaacatagtaagaccccatctcttaaaaaatgaatttggccagacacaggtgcctcacgcctgtaatcccagcactttgggaggctgagctggatcacttgagttcaggagttggagaccaggcctgagcaacaaagcgagatcccatctctacaaaaaccaaaaagttaaaaatcagctgggtacggtggcacgtgcctgtgatcccagctacttgggaggctgaggcaggaggatcgcctgagcccaggaggtggaggttgcagtgagccatgatcgagccactgcactccagcctgggcaacagatgaagaccctatttcagaaatacaactataaaaaaataaataaatcctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaattaaatttcttaaatgaaccaaaaaaaaaaaactc

SEQ ID NO: 454585 - DNA, 3159 bp, Homo sapiens
gacgtgggccccgagtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagggacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaatgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggtcctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccggcctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaagggcaggggatgtcaggcccagagaagcaagtggctttcaacacacaacagcagatggcaccaacgggaccccctggcccttgccctccatcccacccaacctccttaaagcccaaaacccccttaaaacttccagggaaattcaaaccgttgtttttaaccctc

SEQ ID NO: 454586 - DNA, 2682 bp, Homo sapiens
gacgtgggccccgagtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagggacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaatgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggtcctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccggcctgttcccgacacctcccggctgcctggggccacccctgggctcaccacggtggagatagtgacaatgtctcaccaaggtaaagactgggccctccctaggcccctcttcacccagagacgggtcccttcagtggccacgaacattttggtcacgagatggagtccaggtgtcgtcctcactcccttgctgaccttctctcacttgggccgtgtgtctctgggccctcagtttccctatctgtaaagtgggtctaataacagttcttgccctctttgcaaggattaaatgggccaaatcatatgaggggccaggtccttcaggctcctgttcccaaagtcagcacgcac

SEQ ID NO: 454587 - DNA, 1895 bp, Homo sapiens
gacgtgggccccgagtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagggacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatgggtgcgtatccacgacgctgagggctgcagagggaatggaggttgcagtgagccaagacagccccactgcactccagcctgggtgacagagtgagactccgtctcaaaaaaaatagaaccccagtcttcattaccatctactatagttactgacccatggctgatcttgttctttcttccttccctctctttcccaagtattttgaagtt

SEQ ID NO: 454588 - DNA, 1532 bp, Homo sapiens
  misc_feature (1406)..(1406): n is a, c, g, or t
tgtgcgtgtgttctggtctcatatttgtttgttttgagacagggtgtcgctctgtcactgagtctggagtgcagtggcgcaatcagagttcactgcagcctcaaactcttgggctcagttgattctcccacttcagcctcccaagtagctggaactacaggtgaacaccactgtgcccagctaatttattttatttttagtagagatgaggtctcactatgttgcccaggctggtctcgaactcttgacctcatgatccgcccgcctcagcctcccaaaatgctgggattacaggcgtgagccaccaggcccaggccgcaaggcgatctctaaacaaacataaaagaccaggagtcaaggttatggtacgatgcccgtgttttcactccagccacggagctgggtctctggtctcgggggcagctgtgtgacagagcgtgcctctccctacagtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcggtgagtgaccctctctagaaagccagagcccatggcggccccctcccagctggaggcatatgatcctcaagggaccaggccgaggcttccccagccctccagatcgaggacagcattaggtgaatgcttctgtgcgctcattcagaatgtcagcggacaatggccttggtggtgtagaggaatgttggataagcaaatagagagctccatcagatggtgacagggcaaagaaagtcaaaaggagttcagaggccgggcgcggtggctcatgcctgtaatcccaggactttgggaggccgaggctggcggatcacctgaagtcaggagtttgagaccagcttggccatcatgacaaaaccccgtctctattaaaaatacaaaaaattagccaggcgtgggagtgggcgcctgtaatcccagctactcgggaggccgaggtagaaaaatcgcttgaacctaggaggcagaggttgcagtgagccgagatcgcgccactgcattccagcccgggaggcaagagcaaaactccatctcaaaaaaaaatagacatacaacaggggttctcatgagtgcccggcttggttggttccactccttgttgaccccagaaattctcggggggttgaacgccggcgagattcccctgagtctcctgcagtccaagaccagccctggtcaggctgcagtaagaccccgtctcgtgctgttctgtcattttaccccgggtgtgtgtgttcagcgccttagttcccagctactagggagggcctaggccggaggcatggcctgaggcanagggtggacattgaagatttcagctgactgtgatggcgtcactggccccgccgtgtgacacaccagcgcttttccttacccaaacaccccccgaaggttctcggggcggccgcggcgcccaggtca

SEQ ID NO: 454589 - DNA, 260 bp, Homo sapiens
aaaacgttattcagggagaacggctccaagccaagggccatcgtggtggatcctgttcatgggtgcgtatccacgacgctgagggctgcagagggaatggagggagcaggaaggagcttcaggaactggttagtgggctgggcatggtggctcaaagcacctgtaatcccagcactttgggaggccaaggtgggtggatcatcaagaccagcctgaccaacatggtgaaacctcgtctctactaaaaatacaaaaattag

SEQ ID NO: 454590 - DNA, 441 bp, Homo sapiens
tttcatttgttgtgcttgcttaattccctgggaatcagactgttcctgatcggatgacatttctggttaattctttagttggcaggaaatagacacaggaaacgtggtcagtttctgattctggcgttgagagaccctttctccttttcctctctctcagtgggcgacagatgcgaaagaaacgagttccagtgccaagacgggaaatgcatctcctacaagtgggtctgcgatggcagcgctgagtgccaggatggctctgatgagtcccaggagacgtgctgtgagtcccctttgggcatgatatgcatttatttttgtaatagagacagggtctcgccatgttggccaggctggtcttgaatttctggtctcaagtgatccgctggcctcggcctcccaaagtgctgggattacaggcaccacgcctggcctgtgaca

SEQ ID NO: 454591 - DNA, 5199 bp, Homo sapiens
gacgtgggccccgagtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagggacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaatgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggtcctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccggcctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaagggcaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcaccggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgtacatttggcatttgtgttattattttgcactgttttctgtcgtgtgtgttgggatgggatcccaggccagggaaagcccgtgtcaatgaatgccggggacagagaggggcaggttgaccgggacttcaaagccgtgatcgtgaatatcgagaactgccattgtcgtctttatgtccgcccacctagtgcttccacttctatgcaaatgcctccaagccattcacttccccaatcttgtcgttgatgggtatgtgtttaaaacatgcacggtgaggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggtgtgaacccgggaagcggagcttgcagtgagccgagattgcgccactgcagtccgcagtctggcctgggcgacagagcgagactccgtctcaaaaaaaaaaaacaaaaaaaaaccatgcatggtgcatcagcagcccatggcctctggccaggcatggcgaggctgaggtgggaggatggtttgagctcaggcatttgaggctgtcgtgagctatgattatgccactgctttccagcctgggcaacatagtaagaccccatctcttaaaaaatgaatttggccagacacaggtgcctcacgcctgtaatcccagcactttgggaggctgagctggatcacttgagttcaggagttggagaccaggcctgagcaacaaagcgagatcccatctctacaaaaaccaaaaagttaaaaatcagctgggtacggtggcacgtgcctgtgatcccagctacttgggaggctgaggcaggaggatcgcctgagcccaggaggtggaggttgcagtgagccatgatcgagccactgcactccagcctgggcaacagatgaagaccctatttcagaaatacaactataaaaaaataaataaatcctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaattaaatttcttaaatgaaccaaaaaaaaaaaactc

SEQ ID NO: 454592 - DNA, 920 bp, Homo sapiens
gacgtgggccccgagtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtcgtaagtgtggccctgcctttgctattgagcctatctgagtcctggggagtggtctgactttgtctctacggggtcctgctcgagctgcaaggcagctgccccgaactgggctccatctcttgggggctcataccaagcctcttccgcccttcaaatccccccttgaccaggaggcattacaaagtggggatggtgctacctcttcgggtttgtcacgcacagtcagggaggctgtccctgccgagggctagccacctggcacacacactggcaagccgctgtgattcccgctggtcgtgatccccgtgatcctgtgatccccgccccgtgaggctgaacacatagtgacgcttgctagccaagcctcaatgacccacgtaacatgaagggggaaaagccagaaagttctgccaaggagcaaggccaagaatcccgaagggaaatggactttgaagctgggcgtcttcttggctgtcttaatacaagtggcacatccaaatccaaaac

SEQ ID NO: 454593 - DNA, 5145 bp, Homo sapiens
gacgtgggccccgagtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagggacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaatgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggtcctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccggcctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaagggcaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcaccggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgtacatttggcatttgtgttattattttgcactgttttctgtcgtgtgtgttgggatgggatcccaggccagggaaagcccgtgtcaatgaatgccggggacagagaggggcaggttgaccgggacttcaaagccgtgatcgtgaatatcgagaactgccattgtcgtctttatgtccgcccacctagtgcttccacttctatgcaaatgcctccaagccattcacttccccaatcttgtcgttgatgggtatgtgtttaaaacatgcacggtgaggccgggcgcagtggctcacgcctgtaatcccagcactttgggaggccgaggcgggtggatcatgaggtcaggagatcgagaccatcctggctaacaaggtgaaaccccgtctctactaaaaatacaagaggcaggagaatggtgtgaacccgggaagcggagcttgcagtgagccgagattgcgccactgcagtccgcagtctggcctgggcgacagagcgagactccgtctcaaaaaaaaaaaacaaaaaaaaaccatgcatggtgcatcagcagcccatggcctctggccaggcatggcgaggctgaggtgggaggatggtttgagctcaggcatttgaggctgtcgtgagctatgattatgccactgctttccagcctgggcaacatagtaagaccccatctcttaaaaaatgaatttggccagacacaggtgcctcacgcctgtaatcccagcactttgggaggctgagctggatcacttgagttcaggagttggagaccaggcctgagcaacaaagcgagatcccatctctacaaaaaccaaaaagttaaaaatcagctgggtacggtggcacgtgcctgtgatcccagctacttgggaggctgaggcaggaggatcgcctgagcccaggaggtggaggttgcagtgagccatgatcgagccactgcactccagcctgggcaacagatgaagaccctatttcagaaatacaactataaaaaaataaataaatcctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaattaaatttcttaaatgaaccaaaaaaaaaaaactc

SEQ ID NO: 454594 - DNA, 4362 bp, Homo sapiens
gaggacgggagcggttaaccatcgggagggggaccagagtgccccacactaggcacgctagttcactgtcactgcacagctgactcggagcatctgtgggcttaatacaacacccgccagctaccggttctgtgggtcggggcctgaatgtaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagggacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaatgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggtcctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccggcctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaagggcaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcaccggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgtacatttggcatttgtgttattattttgcactgttttctgtcgtgtgtgttgggatgggatcccaggccagggaaagcccgtgtcaatgaatgccggggacagagaggggcaggttgaccgggacttcaaagccgtgatcgtgaatatcgagaactgccattgtcgtctttatgtccgcccacctagtgcttccacttctatgcaaatgcctccaagccattcacttccccaatcttgtcgttgatgggtatgtgtttaaaacatgcacggtgaggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggtgtgaacccgggaagcggagcttgcagtgagccgagattgcgccactgcagtccgcagtctggcctgggcgacagagcgagactccgtctcaaaaaaaaaaaacaaaaaaaaaccatgcatggtgcatcagcagcccatggcctctggccaggcatggcgaggctgaggtgggaggatggtttgagctcaggcatttgaggctgtcgtgagctatgattatgccactgctttccagcctgggcaacatagtaagaccccatctcttaaaaaatgaatttggccagacacaggtgcctcacgcctgtaatcccagcactttgggaggctgagctggatcacttgagttcaggagttggagaccaggcctgagcaacaaagcgagatcccatctctacaaaaaccaaaaagttaaaaatcagctgggtacggtggcacgtgcctgtgatcccagctacttgggaggctgaggcaggaggatcgcctgagcccaggaggtggaggttgcagtgagccatgatcgagccactgcactccagcctgggcaacagatgaagaccctatttcagaaatacaactataaaaaaataaataaatcctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaattaaatttcttaaatgaaccaaaaaaaaaaaactc

SEQ ID NO: 454595 - DNA, 4271 bp, Homo sapiens
gacgtgggccccgagtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagggacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaatgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggtcctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccggcctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaagggcaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcaccggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgtacatttggcatttgtgttattattttgcactgttttctgtcgtgtgtgttgggatgggatcccaggccagggaaagcccgtgtcaatgaatgccggggacagagaggggcaggttgaccgggacttcaaagccgtgatcgtgaatatcgagaactgccattgtcgtctttatgtccgcccacctagtgcttccacttctatgcaaatgcctccaagccattcacttccccaatcttgtcgttgatgggtatgtgtttaaaacatgcacggtgaggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggtgtgaacccgggaagcggagcttgcagtgagccgagattgcgccactgtactccagcctgggcaacaaaagtgaaactctgtctgaaacaaacaaacaaacaaacaaacagacaaacaaaaaaactagttgtggagagagggtggcctgtgtctcatcccagtgtttaacgggatttgtcatcttccttgctgcctgtttaggacaaagtattttggacagatatcatcaacgaagccattttcagtacaactgcggtgggggtaggagctc

SEQ ID NO: 454596 - DNA, 3361 bp, Homo sapiens
ccaaaaccaaaagggaaaaacaaaaaaactagttgtggagagagggtggcctgtgtctcatcgccagtgtttaacgggatttgtcatcttccttgctgcctgtttaggacaaagtattttggacagatatcatcaacgaagccattttcagtgccaaccgcctcacaggttccgatgtcaacttgttggctgaaaacctactgtccccagaggatatggtcctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccggcctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaagggcaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcaccggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgtacatttggcatttgtgttattattttgcactgttttctgtcgtgtgtgttgggatgggatcccaggccagggaaagcccgtgtcaatgaatgccggggacagagaggggcaggttgaccgggacttcaaagccgtgatcgtgaatatcgagaactgccattgtcgtctttatgtccgcccacctagtgcttccacttctatgcaaatgcctccaagccattcacttccccaatcttgtcgttgatgggtatgtgtttaaaacatgcacggtgaggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggtgtgaacccgggaagcggagcttgcagtgagccgagattgcgccactgcagtccgcagtctggcctgggcgacagagcgagactccgtctcaaaaaaaaaaaacaaaaaaaaaccatgcatggtgcatcagcagcccatggcctctggccaggcatggcgaggctgaggtgggaggatggtttgagctcaggcatttgaggctgtcgtgagctatgattatgccactgctttccagcctgggcaacatagtaagaccccatctcttaaaaaatgaatttggccagacacaggtgcctcacgcctgtaatcccagcactttgggaggctgagctggatcacttgagttcaggagttggagaccaggcctgagcaacaaagcgagatcccatctctacaaaaaccaaaaagttaaaaatcagctgggtacggtggcacgtgcctgtgatcccagctacttgggaggctgaggcaggaggatcgcctgagcccaggaggtggaggttgcagtgagccatgatcgagccactgcactccagcctgggcaacagatgaagaccctatttcagaaatacaactataaaaaaataaataaatcctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaattaaatttcttaaatgaaccaaaaaaaaaaaactc

SEQ ID NO: 454597 - DNA, 1857 bp, Homo sapiens
aagcgcccttcagccggctccgcactccagtcccctggtctccgacacacgtactcaccgaccgagtcggggaggcttctccccgcatgcaccatcatccgggcctggtgcccatcctcccgacccctacccacttccattcccgtggtctccttgcactttctcagttcagagttgtacactgtgtacatttggcatttgtgttattattttgcactgttttctgtcgtgtgtgttgggatgggatcccaggccagggaaagcccgtgtcaatgaatgccggggacagagaggggcaggttgaccgggacttcaaagccgtgatcgtgaatatcgagaactgccattgtcgtctttatgtccgcccacctagtgcttccacttctatgcaaatgcctccaagccattcacttccccaatcttgtcgttgatgggtatgtgtttaaaacatgcacggtgaggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggtgtgaacccgggaagcggagcttgcagtgagccgagattgcgccactgcagtccgcagtctggcctgggcgacagagcgagactccgtctcaaaaaaaaaaaacaaaaaaaaaccatgcatggtgcatcagcagcccatggcctctggccaggcatggcgaggctgaggtgggaggatggtttgagctcaggcatttgaggctgtcgtgagctatgattatgccactgctttccagcctgggcaacatagtaagaccccatctcttaaaaaatgaatttggccagacacaggtgcctcacgcctgtaatcccagcactttgggaggctgagctggatcacttgagttcaggagttggagaccaggcctgagcaacaaagcgagatcccatctctacaaaaaccaaaaagttaaaaatcagctgggtacggtggcacgtgcctgtgatcccagctacttgggaggctgaggcaggaggatcgcctgagcccaggaggtggaggttgcagtgagccatgatcgagccactgcactccagcctgggcaacagatgaagaccctatttcagaaatacaactataaaaaaataaataaatcctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaattaaatttcttaaatgaaccaaaaaaaaaaaactc

SEQ ID NO: 454598 - DNA, 3568 bp, Homo sapiens
  misc_feature (3442)..(3442): n is a, c, g, or t
gacgtgggccccgagtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagggacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaatgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggtcctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccggcctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcggtgagtgaccctctctagaaagccagagcccatggcggccccctcccagctggaggcatatgatcctcaagggaccaggccgaggcttccccagccctccagatcgaggacagcattaggtgaatgcttctgtgcgctcattcagaatgtcagcggacaatggccttggtggtgtagaggaatgttggataagcaaatagagagctccatcagatggtgacagggcaaagaaagtcaaaaggagttcagaggccgggcgcggtggctcatgcctgtaatcccaggactttgggaggccgaggctggcggatcacctgaagtcaggagtttgagaccagcttggccatcatgacaaaaccccgtctctattaaaaatacaaaaaattagccaggcgtgggagtgggcgcctgtaatcccagctactcgggaggccgaggtagaaaaatcgcttgaacctaggaggcagaggttgcagtgagccgagatcgcgccactgcattccagcccgggaggcaagagcaaaactccatctcaaaaaaaaatagacatacaacaggggttctcatgagtgcccggcttggttggttccactccttgttgaccccagaaattctcggggggttgaacgccggcgagattcccctgagtctcctgcagtccaagaccagccctggtcaggctgcagtaagaccccgtctcgtgctgttctgtcattttaccccgggtgtgtgtgttcagcgccttagttcccagctactagggagggcctaggccggaggcatggcctgaggcanagggtggacattgaagatttcagctgactgtgatggcgtcactggccccgccgtgtgacacaccagcgcttttccttacccaaacaccccccgaaggttctcggggcggccgcggcgcccaggtca

SEQ ID NO: 454599 - DNA, 2134 bp, Homo sapiens
gacgtgggccccgagtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagggacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctctgtgctgtccctcctctgtgctgtccgacagcacagaggaggcccagactcacctgtcctgatgcccgcgcccaagcacactgctcacatgcccatgcacactgccagcctattcaccctgggtactgccacctacatttgtcaacccttccagggtctgggccagaggaagaattgattccagcaccttctcacccctgactaaggcttagagctcaggccctgcacttatcccacaccccaagaaggaatgtcctgggcgggacccccacctcagagcctgcaggccggctcccactcctgcagccctcagctgcttcc

SEQ ID NO: 454600 - DNA, 682 bp, Homo sapiens
gctctcacccaaaaacaattagcccagagatttggacatttcaaccagccttatagctgttctcatcatcaccttctgcattgtgaccgtgcttggaagggaggctctcaccaaaggggcgctgtgggcagtctttctgctcgcagggtctgccctcctctgtgccgtggtcacgggcgtcatctggaggcagcccgagagcaagaccaagctctcatttaaggttcccttcctgccagtgctccccatcctgagcatcttcgtgaacgtctatctcatgatgcagctggaccagggcacctgggtccggtttgctgtgtggatgctgataggcttcatcatctactttggctatggcctgtggcacagcgaggaggcgtccctggatgccgaccaagcaaggactcctgacggcaacttggaccagtgcaagtgacgcacagccccgccccccggaggtggcagcagccccgagggacgcccccagaggaccgggaggcaccccaccctccccaccagtgcaacagaaaccacctgcgtccacaccctcactgcagccaaaggtgcaattacttgacctgcagccccagcccaccctcggctctgcagccggttctccgggccctggtcacctccagacagctgcctggccggggccactaggctgcggctggccactgtg

SEQ ID NO: 454601 - DNA, 2315 bp, Homo sapiens
gtggccagtggtgtggatgtgaatattcatccctgtggaggaaaatagtggggtctctgagatttgattctgaaaccttccttgtatccctcctgagacatctttgctgcaagatcgaggctgtcctctggtgagaaggtggtgaggcttcccgtcatattccagctctgaacagcaacatggggtgcaaagtcctgctcaacattgggcagcagatgctgcggcggaaggtggtggactgtagccgggaggagacgcggctgtctcgctgcctgaacacttttgatctggtggccctcggggtgggcagcacactgggtgctggtgtctacgtcctggctggagctgtggcccgtgagaatgcaggccctgccattgtcatctccttcctgatcgctgcgctggcctcagtgctggctggcctgtgctatggcgagtttggtgctcgggtccccaagacgggctcagcttacctctacagctatgtcaccgttggagagctctgggccttcatcaccggctggaacttaatcctctcctacatcatcggtacttcaagcgtagcgagggcctggagcgccaccttcgacgagctgataggcagacccatcggggagttctcacggacacacatgactctgaacgcccccggcgtgctggctgaaaaccccgacatattcgcagtgatcataattctcatcttgacaggacttttaactcttggtgtgaaagagtcggccatggtcaacaaaatattcacttgtattaacgtcctggtcctgggcttcataatggtgtcaggatttgtgaaaggatcggttaaaaactggcagctcacggaggaggattttgggaacacatcaggccgtctctgtttgaacaatgacacaaaagaagggaagcccggtgttggtggattcatgcccttcgggttctctggtgtcctgtcgggggcagcgacttgcttctatgccttcgtgggctttgactgcatcgccaccacaggtgaagaggtgaagaacccacagaaggccatccccgtggggatcgtggcgtccctcttgatctgcttcatcgcctactttggggtgtcggctgccctcacgctcatgatgccctacttctgcctggacaataacagccccctgcccgacgcctttaagcacgtgggctgggaaggtgccaagtacgcagtggccgtgggctccctctgcgctctttccgccagtcttctaggttccatgtttcccatgcctcgggttatctatgccatggctgaggatggactgctatttaaattcttagccaacgtcaatgataggaccaaaacaccaataatcgccacattagcctcgggtgccgttgctgctgtgatggccttcctctttgacctgaaggacttggtggacctcatgtccattggcactctcctggcttactcgttggtggctgcctgtgtgttggtcttacggtaccagccagagcagcctaacctggtataccagatggccagtacttccgacgagttagatccagcagaccaaaatgaattggcaagcaccaatgattcccagctggggtttttaccagaggcagagatgttctctttgaaaaccatactctcacccaaaaacatggagccttccaaaatctctgggctaattgtgaacatttcaaccagccttatagctgttctcatcatcaccttctgcattgtgaccgtgcttggaagggaggctctcaccaaaggggcgctgtgggcagtctttctgctcgcagggtctgccctcctctgtgccgtggtcacgggcgtcatctggaggcagcccgagagcaagaccaagctctcatttaaggttcccttcctgccagtgctccccatcctgagcatcttcgtgaacgtctatctcatgatgcagctggaccagggcacctgggtccggtttgctgtgtggatgctgataggcttcatcatctactttggctatggcctgtggcacagcgaggaggcgtccctggatgccgaccaagcaaggactcctgacggcaacttggaccagtgcaagtgacgcacagccccgccccccggaggtggcagcagccccgagggacgcccccagaggaccgggaggcaccccaccctccccaccagtgcaacagaaaccacctgcgtccacaccctcactgcagccaaaggtgcaattacttgacctgcagccccagcccaccctcggctctgcagccggttctccgggccctggtcacctccagacagctgcctggccggggccactaggctgcggctggccactgtg

SEQ ID NO: 454602 - DNA, 1061 bp, Homo sapiens
gcggccgcgggctcccgctaaccgcagcctccactcctctccccgcgcgccgcgcccccgccccgccccgcccggtctcgccggccgagcgtccgttggtccttgagcgcgtccgacagtctgtctgttcgcgatcctgccggagccccgccgccgccggcttggattctgaaaccttccttgtatccctcctgagacatctttgctgcaagatcgaggctgtcctctggtgagaaggtggtgaggcttcccgtcatattccagctctgaacagcaacatggggtgcaaagtcctgctcaacattgggcagcagatgctgcggcggaaggtggtggactgtagccgggaggagacgcggctgtctcgctgcctgaacacttttgatctggtggccctcggggtgggcagcacactgggtgctggtgtctacgtcctggctggagctgtggcccgtgagaatgcaggccctgccattgtcatctccttcctgatcgctgcgctggcctcagtgctggctggcctgtgctatggcgagtttggtgctcgggtccccaagacgggctcagcttacctctacagctatgtcaccgttggagagctctgggccttcatcaccggctggaacttaatcctctcctacatcatcggtacttcaagcgtagcgagggcctggagcgccaccttcgacgagctgataggcagacccatcggggagttctcacggacacacatgactctgaacgcccccggcgtgctggctgaaaaccccgacatattcgcagtgatcataattctcatcttgacaggacttttaactcttggtgtgaaagagtcggccatggtcaacaaaatattcacttgtattaacgtcctggtcctgggcttcataatggtgtcaggatttgtgaaaggatcggttaaaaactggcagctcacggaggaggattttgggaacacatcaggccgtctctgtttgaacaagtgagttgctgcttctgaccatttttcttagttgacatttaatgacatagattgtatgggggatataactggctaggat

SEQ ID NO: 454603 - DNA, 420 bp, Homo sapiens
cccttttgctccctacagcagtaattttgtgggaagtggcctagtatctttagcatctgagggccgctgccacttctcagagcaagagagatcctctcagggtattcctctgggctgctcatggtggaggtcatgtcgccccgaaggagagaccatggaggatgttccccagaagcaacagcgggaggtggtgttcccggtctctcctcgtctatctacaatgcagcatttgactatatccttcccattttataccttgtgtcccgggcagctcactttggaggcttattgagaacttgagttggtgcacgtcattttgcttgaagcagatgtggcggtcacgcaatgcctttcttcccaggtaccagccagagcagcctaacctggtataccagatggccagtacttccgacgagttag

SEQ ID NO: 454604 - DNA, 431 bp, Homo sapiens
ggtatctggaggtcacctaggagggcctgggaagcacccacaaccttggtgatttaaacccctgatccccgcccccagaaagataattaatccaccccattcccagaggctcacagaggtctgcagaggctcgatgcacttggattctttttcagtcgccttcttatccccatccaggaaggaccttcccagtttgtggttaacactcagacaaagttttgtgtctatgcactttttcaggacttttaactcttggtgtgaaagagtcggccatggtcaacaaaatattcacttgtattaacgtcctggtcctgggcttcataatggtgtcaggatttgtgaaaggatcggttaaaaactggcagctcacggaggaggattttgggaacacatcaggccgtctctgtttgaacaagtgagttgctgcttct

SEQ ID NO: 454605 - DNA, 2414 bp, Homo sapiens
gcggccgcgggctcccgctaaccgcagcctccactcctctccccgcgcgccgcgcccccgccccgccccgcccggtctcgccggccgagcgtccgttggtccttgagcgcgtccgacagtctgtctgttcgcgatcctgccggagccccgccgccgccggcttggattctgaaaccttccttgtatccctcctgagacatctttgctgcaagatcgaggctgtcctctggtgagaaggtggtgaggcttcccgtcatattccagctctgaacagcaacatggggtgcaaagtcctgctcaacattgggcagcagatgctgcggcggaaggtggtggactgtagccgggaggagacgcggctgtctcgctgcctgaacacttttgatctggtggccctcggggtgggcagcacactgggtgctggtgtctacgtcctggctggagctgtggcccgtgagaatgcaggccctgccattgtcatctccttcctgatcgctgcgctggcctcagtgctggctggcctgtgctatggcgagtttggtgctcgggtccccaagacgggctcagcttacctctacagctatgtcaccgttggagagctctgggccttcatcaccggctggaacttaatcctctcctacatcatcggtacttcaagcgtagcgagggcctggagcgccaccttcgacgagctgataggcagacccatcggggagttctcacggacacacatgactctgaacgcccccggcgtgctggctgaaaaccccgacatattcgcagtgatcataattctcatcttgacaggacttttaactcttggtgtgaaagagtcggccatggtcaacaaaatattcacttgtattaacgtcctggtcctgggcttcataatggtgtcaggatttgtgaaaggatcggttaaaaactggcagctcacggaggaggattttgggaacacatcaggccgtctctgtttgaacaatgacacaaaagaagggaagcccggtgttggtggattcatgcccttcgggttctctggtgtcctgtcgggggcagcgacttgcttctatgccttcgtgggctttgactgcatcgccaccacaggtgaagaggtgaagaacccacagaaggccatccccgtggggatcgtggcgtccctcttgatctgcttcatcgcctactttggggtgtcggctgccctcacgctcatgatgccctacttctgcctggacaataacagccccctgcccgacgcctttaagcacgtgggctgggaaggtgccaagtacgcagtggccgtgggctccctctgcgctctttccgccagtcttctaggttccatgtttcccatgcctcgggttatctatgccatggctgaggatggactgctatttaaattcttagccaacgtcaatgataggaccaaaacaccaataatcgccacattagcctcgggtgccgttgctgctgtgatggccttcctctttgacctgaaggacttggtggacctcatgtccattggcactctcctggcttactcgttggtggctgcctgtgtgttggtcttacggtaccagccagagcagcctaacctggtataccagatggccagtacttccgacgagttagatccagcagaccaaaatgaattggcaagcaccaatgattcccagctggggtttttaccagaggcagagatgttctctttgaaaaccatactctcacccaaaaacatggagccttccaaaatctctgggctaattgtgaacatttcaaccagccttatagctgttctcatcatcaccttctgcattgtgaccgtgcttggaagggaggctctcaccaaaggggcgctgtgggcagtctttctgctcgcagggtctgccctcctctgtgccgtggtcacgggcgtcatctggaggcagcccgagagcaagaccaagctctcatttaaggttcccttcctgccagtgctccccatcctgagcatcttcgtgaacgtctatctcatgatgcagctggaccagggcacctgggtccggtttgctgtgtggatgctgataggcttcatcatctactttggctatggcctgtggcacagcgaggaggcgtccctggatgccgaccaagcaaggactcctgacggcaacttggaccagtgcaagtgacgcacagccccgccccccggaggtggcagcagccccgagggacgcccccagaggaccgggaggcaccccaccctccccaccagtgcaacagaaaccacctgcgtccacaccctcactgcagccaaaggtgcaattacttgacctgcagccccagcccaccctcggctctgcagccggttctccgggccctggtcacctccagacagctgcctggccggggccactaggctgcggctggccactgtg

SEQ ID NO: 454606 - DNA, 2239 bp, Homo sapiens
gcggccgcgggctcccgctaaccgcagcctccactcctctccccgcgcgccgcgcccccgccccgccccgcccggtctcgccggccgagcgtccgttggtccttgagcgcgtccgacagtctgtctgttcgcgatcctgccggagccccgccgccgccggcttggattctgaaaccttccttgtatccctcctgagacatctttgctgcaagatcgaggctgtcctctggtgagaaggtggtgaggcttcccgtcatattccagctctgaacagcaacatggggtgcaaagtcctgctcaacattgggcagcagatgctgcggcggaaggtggtggactgtagccgggaggagacgcggctgtctcgctgcctgaacacttttgatctggtggccctcggggtgggcagcacactgggtgctggtgtctacgtcctggctggagctgtggcccgtgagaatgcaggccctgccattgtcatctccttcctgatcgctgcgctggcctcagtgctggctggcctgtgctatggcgagtttggtgctcgggtccccaagacgggctcagcttacctctacagctatgtcaccgttggagagctctgggccttcatcaccggctggaacttaatcctctcctacatcatcggtacttcaagcgtagcgagggcctggagcgccaccttcgacgagctgataggcagacccatcggggagttctcacggacacacatgactctgaacgcccccggcgtgctggctgaaaaccccgacatattcgcagtgatcataattctcatcttgacaggacttttaactcttggtgtgaaagagtcggccatggtcaacaaaatattcacttgtattaacgtcctggtcctgggcttcataatggtgtcaggatttgtgaaaggatcggttaaaaactggcagctcacggaggaggattttgggaacacatcaggccgtctctgtttgaacaatgacacaaaagaagggaagcccggtgttggtggattcatgcccttcgggttctctggtgtcctgtcgggggcagcgacttgcttctatgccttcgtgggctttgactgcatcgccaccacaggtgaagaggtgaagaacccacagaaggccatccccgtggggatcgtggcgtccctcttgatctgcttcatcgcctactttggggtgtcggctgccctcacgctcatgatgccctacttctgcctggacaataacagccccctgcccgacgcctttaagcacgtgggctgggaaggtgccaagtacgcagtggccgtgggctccctctgcgctctttccgccagtcttctaggttccatgtttcccatgcctcgggttatctatgccatggctgaggatggactgctatttaaattcttagccaacgtcaatgataggaccaaaacaccaataatcgccacattagcctcgggtgccgttgctgctgtgatggccttcctctttgacctgaaggacttggtggacctcatgtccattggcactctcctggcttactcgttggtggctgcctgtgtgttggtcttacggtaccagccagagcagcctaacctggtataccagatggccagtacttccgacgagttagatccagcagaccaaaatgaattggcaagcaccaatgattcccagctggggtttttaccagaggcagagatgttctctttgaaaaccatactctcacccaaaaacatggagccttccaaaatctctgggctaattgtgaacatttcaaccagccttatagctgttctcatcatcaccttctgcattgtgaccgtgcttggaagggaggctctcaccaaaggggcgctgtgggcagtctttctgctcgcagggtctgccctcctctgtgccgtggtcacgggcgtcatctggaggcagcccgagagcaagaccaagctctcatttaaggtgagcagctcggcctagggaaggaaccctggtacacagaccctggccctcctgatgcctggccagccctgcgtgggctcagccgggcctgggtgctcccgaggaaggtttttgctagccagcttcaggtaagatggggcaggggtcctgaaggcacagagaggaccagaccctggaaggaggcagcagcccttctcccctggacgtttccctgagtagtcaagggcaggctgacaccttcctgcatgacacaggccaagagagacctcgccagtccctggata

SEQ ID NO: 454607 - DNA, 953 bp, Homo sapiens
tcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagcaaaaaaaaaaacacagacgagcacccggcaccaccacaaaggggg

SEQ ID NO: 454608 - DNA, 657 bp, Homo sapiens
tccagcgcccagagagacaccagagtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagcagaagaaaaaagagagaaaaaaagaagaaaaa

SEQ ID NO: 454609 - DNA, 462 bp, Homo sapiens
  misc_feature (11)..(12): n is a, c, g, or t
  misc_feature (14)..(16): n is a, c, g, or t
  misc_feature (18)..(19): n is a, c, g, or t
agcctactcanncnnncnntagccatggagtaaatggcatgccatttactcaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatgtaaatggcatgccatttactccatggcgtcagcgaagggttgtagtagcccgtaggggcctacaacgttggggcctttgcgtagttgtatatggcctagaatttttcggtcggtaagcattaggaatgccattgcg

SEQ ID NO: 454610 - DNA, 363 bp, Homo sapiens
gcggccgcctactactactaaattcacggccgctcgacccaagacctacactgttggctgtgagatatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagcaccagcagacactgtttctgtg

SEQ ID NO: 454611 - DNA, 781 bp, Homo sapiens
  misc_feature (11)..(12): n is a, c, g, or t
  misc_feature (14)..(16): n is a, c, g, or t
  misc_feature (18)..(19): n is a, c, g, or t
agcctactcanncnnncnntagccatggagtaaatggcatgccatttactcaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 454612 - DNA, 812 bp, Homo sapiens
gagctgggctgcagcttgggtgctggccaccaggcccgtgcactcccgtgccagatgcctgtctactcagcttggcctgcggaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 454613 - DNA, 1465 bp, Homo sapiens
tcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagcaaaaaaaacgcaaaaggaacaaaacaaaaaaaaactgtgtgagagggggaccacggagccccgagaaacgctttcagaacccaatgcgcgaggggaggggggcccccagcaggctcacgcggtcacccagggcgacaaccagcgtggttccaccaaagggaacacacgcggcaacaggaccacagagggcagtggcatattctacaccagatcaaaaaacacgcccggagggacaaccgccagaagcaggacttcgggacgacaaacacccggagatgtgcgacatacctgagaggaggacacacaccgcgggggatcacttatcgcacacgcgggggcgacccacagacggagcggcactcgacgagaccactacaaaaatataacacggccccgcgacccacggggggggtagcacccacgaagaacacacacgcgacacacagaacgaaggaaacgacgaaaacgcaagagactgccacagccagccaacagcacagcaacacaccagccagcgacagcgccacaagagaaacgcgacaccacaccggcaaaag

SEQ ID NO: 454614 - DNA, 938 bp, Homo sapiens
tcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagcacaacccaataaaactgatgttactagcca

SEQ ID NO: 454615 - DNA, 1566 bp, Homo sapiens
tcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaagacttaaaataaaaaaaaactaaaaaaaccaaaccaaaattaaggctaattggaaaaattggcccaatagaggaaacatttaccaataaaaagcccgttgtttaacaaggtccaaattggtaaaaccttgaagaaaccaaatttaagggctttaaaaaaaatacccctttgtcaaatttgtaaaaatagcaaaaaggcccgaaatggacggtctttccaaaaaattgcgcattttaaaaagcaaagggaatctcaaggggaaatattggggaaaaattccctttaaaagttcggaaaatccagaaaatttttaacccaataggccaaaattcgaaaaaaaccttaaaaaatcaaaaaaatttaacaaaaaaggcataaattattaacaaaattgggaaaaaaggttccctttataaaaaaaactggtttcttaaaaagtaaaagggtgataaaaacgcgtttattctgggtaaatgccccataattcggaacacaaagccctaaaaaaaagttttattgaggaaaaagagaggcctaaaagataaa

SEQ ID NO: 454616 - DNA, 628 bp, Homo sapiens
  misc_feature (20)..(21): n is a, c, g, or t
agcatgatacgactcgagtnngtaccctcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 454617 - DNA, 1078 bp, Homo sapiens
tcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagacccagtgacatttccctcaatgggaggggctgtcctggggtatgtacttaggtggggtgagagcaagtctccccagcggctcagtgttgaaagctgaggagaggaagttctgctccacgggggaggcagggagaagccctcagagatgtttccctcctcccttccaggtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 454618 - DNA, 1512 bp, Homo sapiens
tcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggcttgtgcacctggcagtccctgcggtcccagatagcctgaatcctgcccggagtggaagctgaagcctgcacagtgtccaccctgttcccactcccatctttcttccggacaatgaaataaagagttaccacccagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaagacttaaaataaaaaaaaactaaaaaaaccaaaccaaaattaaggctaattggaaaaattggcccaatagaggaaacatttaccaataaaaagcccgttgtttaacaaggtccaaattggtaaaaccttgaagaaaccaaatttaagggctttaaaaaaaatacccctttgtcaaatttgtaaaaatagcaaaaaggcccgaaatggacggtctttccaaaaaattgcgcattttaaaaagcaaagggaatctcaaggggaaatattggggaaaaattccctttaaaagttcggaaaatccagaaaatttttaacccaataggccaaaattcgaaaaaaaccttaaaaaatcaaaaaaatttaacaaaaaaggcataaattattaacaaaattgggaaaaaaggttccctttataaaaaaaactggtttcttaaaaagtaaaagggtgataaaaacgcgtttattctgggtaaatgccccataattcggaacacaaagccctaaaaaaaagttttattgaggaaaaagagaggcctaaaagataaa

SEQ ID NO: 454619 - DNA, 1120 bp, Homo sapiens
tcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggtgaggcaccgtccccgcgccctgtgccacaccaaccagtccctggggcgcggcctagcaaccacgagggggcgaggctctgatgggaatggtcccactggaaatggggaccaccccaatttcagtctatcagaaggccgggcctttggcagcttggcagctcagccaatcacaagctgcttgtcggtccccgccccgcctttctccttaggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 454620 - DNA, 967 bp, Homo sapiens
tcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgagtgcctggaccctgacctccaacgggagatccttcccggggccattccctaaatcgtgggcttgtttcttgctccctctggctattctgtgtccctgtggctgctccccaaccctaagggctgtccctgatctctcttgctatttccccaagcccgagactgctcccttacaaattctggctgctccctttccctgtgtccaataccgtgtgatcacctgtccctccctggtccctctaattctcccttgtgactattctgtaatcccactccccgttcctgagcccccgggattgtttcttggttccccagaatgttctcca

SEQ ID NO: 454621 - DNA, 697 bp, Homo sapiens
tcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacacctgttcccactcccatctttcttccggacaatgaaataaagagttaccacccagca

SEQ ID NO: 454622 - DNA, 525 bp, Homo sapiens
acgtccatgtatgtcatatgtgtgactgtccttttctcttgttggagcttggagtagtgatggggttgctctgatatgtcgcacagtcaggcatgatgatgcacggccacggcaggagtttctcatggtcggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 454623 - DNA, 701 bp, Homo sapiens
tccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctgggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 454624 - DNA, 909 bp, Homo sapiens
tcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 454625 - DNA, 626 bp, Homo sapiens
tccagcgcccagagagacaccagagtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 454626 - DNA, 486 bp, Homo sapiens
agccaccattccaggacactgatttactggcttactgttacctttcaggacccagtgacatttccctcaatgggaggggctgtcctggggtatgtacttaggtggggtgagagcaagtctccccagcggctcagtgttgaaagctgaggagaggaagttctgctccacgggggaggcagggagaagccctcagagatgtttccctcctcccttccaggtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 454627 - DNA, 431 bp, Homo sapiens
  misc_feature (7)..(7): n is a, c, g, or t
  misc_feature (231)..(231): n is a, c, g, or t
  misc_feature (249)..(249): n is a, c, g, or t
  misc_feature (264)..(264): n is a, c, g, or t
  misc_feature (360)..(360): n is a, c, g, or t
  misc_feature (380)..(380): n is a, c, g, or t
  misc_feature (412)..(412): n is a, c, g, or t
ggaaccnaccaatccctctcccccaggccccaggacctgcagggcaatggctgggtgagactgtccacagggcctgcacctgtgtcccaccccacccacagacggccttctgcaattccgacctcgtcatcagggccaagttcgtggggacaccagaagtcaaccagaccaccttataccagcgttatgagatcaagatgaccaagagtggaatgtcagcaggaccccatncgccattccctgtgtctnttacacgctgtattngtgtattcaccgggggcattatttttcatttgttaatgttcatttcccacccctggttccagcctcgattttggtttttatttttgaggcccccanttccaccaccccagttttcnggggggcacaatgttttgttgcatgttccccnagggaggccaccttgggga

SEQ ID NO: 454628 - DNA, 759 bp, Homo sapiens
caatcgagctcgcaccctgccatttactcaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 454629 - DNA, 940 bp, Homo sapiens
tcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagcagaagaaaaaagagagaaaaaaagaagaaaaa

SEQ ID NO: 454630 - DNA, 964 bp, Homo sapiens
tcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagcaaaacagcaaagaccccaaaagagcaaagacacaaaaagagcaaagaccccaaaag

SEQ ID NO: 454631 - DNA, 643 bp, Homo sapiens
agctcggtaccccttcgacggtgttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 454632 - DNA, 654 bp, Homo sapiens
cagctcggtacagtgtactccaaaaacagacgggcttctcgtaattccggacgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 454633 - DNA, 950 bp, Homo sapiens
tcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagacccagtgacatttccctcaatgggaggggctgtcctggggtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 454634 - DNA, 1107 bp, Homo sapiens
tcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagacccagtgacatttccctcaatgggaggggctgtcctggggtatgtacttaggtggggtgagagcaagtctccccagcggctcagtgttgaaagctgaggagaggaagttctgctccacgggggaggcagggagaagccctcagagatgtttccctcctcccttccaggtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagcacaacccaataaaactgatgttactagcca

SEQ ID NO: 454635 - DNA, 874 bp, Homo sapiens
tcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 454636 - DNA, 784 bp, Homo sapiens
tcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 454637 - DNA, 1084 bp, Homo sapiens
tcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggtgaggcaccgtccccgcgccctgtgccacaccaaccagtccctggggcgcggcctagcaaccacgagggggcgaggctctgatgggaatggtcccactggaaatggggaccaccccaatttcagtctatcagaaggccgggcctttggcagcttggcagctcagccaatcacaagctgcttgtcggtccccgccccgcctttctccttaggaaaactgcaggatggactcttgcacatcactacctgcagttttgtggctccctggaacagcctgagcttagctcagcgccggggcttcaccaagacctacactgttggctgtgaggaatgcacaagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 454638 - DNA, 672 bp, Homo sapiens
  misc_feature (465)..(465): n is a, c, g, or t
  misc_feature (470)..(470): n is a, c, g, or t
  misc_feature (476)..(476): n is a, c, g, or t
  misc_feature (478)..(478): n is a, c, g, or t
  misc_feature (487)..(487): n is a, c, g, or t
  misc_feature (508)..(508): n is a, c, g, or t
  misc_feature (515)..(515): n is a, c, g, or t
  misc_feature (554)..(554): n is a, c, g, or t
  misc_feature (632)..(633): n is a, c, g, or t
  misc_feature (642)..(642): n is a, c, g, or t
tcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatgtttgggggaanaaaantttaananaagggtacnacaaccacaacgaggaggtantcaaggncggaaacctcgtcagagatggactacttgcatagctctnacctgcagtctcttggcgctgcgctgagagctcccctgtgtttacgcgtcgagccccggggcttcacgctagatcaanncactggtgnctattcgacgggtaccgagctagattagta

SEQ ID NO: 454639 - DNA, 1437 bp, Homo sapiens
ctggtaaccgctcctgcctctagacttgcacatgtgtgaaaggaagaatttacaaagctattcgcagcattgtttttaatagcagaagactgaaaataccttcagatgtccatcaaaaaaggactggatgaataaattacagggcatcatcaaatggaaaaccatgcagcagtgaaaaagtctgggatgatctataagatacattggtaagcagaaaggaaaaggcaaggcacagaagaacagggcttatagcatgctaactttttcagtcaaaaaggaaagcaaagcaaaaactaaaatcaatatttgttattagcttcttttgtaataacaaatacattttgaagcaggtaaaagaaactaaaaatttaattacttgtgagggagcggtgggactacgcagatagtgggtagggccgggagcaagacttttcatagtacctttttatgtattttattttgattcatatgaatgtactatcttttaaaaaaataaaaatatttccaagttgtaattcccaatcaccatagtaatttgcagcactggaaatgtttttaaaatgaaagggctacagctgatagtgtgttacccagctgaacttgaagactcctctttggaagatacacgcccatgaacaaactcccaagtgacttgttcacaagtattcagaacagtgcttatgttaagaaaaaactgcaaatgatgaaaatgttcaacaggtacacaggtgtgcaagggtttgcctattcagatggatcacattagattatatggctattacacctcaactacttcaacatacagcaatccctatgtgaaaacactgtgatatgtacgcagataagcaatgttcagacaagaatccagaaggatacggacaatttgatatttgcaaagttctaattgaataaaactgcttgagaatttcctttttttaattacaaatttgaggagtgaaatgatctagttgagaaagaagcaaaaatatatattttttaaaatgccaaaatatgaactgaatatgagagctacataaaagcctattcaatgagaggcaagcaacattcaagaacattaggccaaaggcctgggtgtgaatgtggggaatgtttgtcaagggcgaggccaaatagacagaggagggaggagaaacccaaagggactctagtgccgtgatctgagcaacctccaaaaacatatcccaggaaatgtaactggatgagaccaggagacaaaaatgggtggaaaataaataagctgtggacaacagcagctctttcaacccaaacgttagcaaccctcatatatactccagtgtcaaaacataccttatgtctttaaaaaggtacaaaagggatgaaaagcagatctgtgcttcatctcactgagcagtttttccaaagcatccctccctggagaaatgtgaagtcagtttc

SEQ ID NO: 454640 - DNA, 2503 bp, Homo sapiens
cacagtgatccctgcgcgcgtctcctgctcgggtcagtgcgccgcgctgcgctgggcgccatggcgctccccggagcccgggctcgcggctgggcggcagcagccagagcggcccagaggcgccgccgcgtggagaacgcaggagggtccccgagtcctgagcctgcgggccggcgcgcggcgctttacgtacactggccttactgcgagaagcgctgcagttactgcaacttcaacaagtacatccctcgccgcctggaggaggctgccatgcagaagtgtctggtgaccgaagctcagacgctgctgcggctcagcggggtgcaacgggtggagtctgtgttctttggtggggggacccccagtctagccagtccccacacggtggctgctgtcctggaggctgtggcacaggcagcccacctgcctgcagacttggaagtcacattggaggctaatcctacttcagctccgggctccagactggcagagttcggggcagcaggggttaacaggttgtctataggcctccagtccctagatgacactgagctccggctgttgggacggacgcactcggcctgcgatgctctgcggacgctggcagaggcccggcgcctctttcccgggcgcgtgtctgtagacttgatgctggggctgccggcacagcaggtggggccgtggcttgggcagctgcaggaactgctgcaccactgtgatgaccacctctccctctaccagctgtccctggagcggggcaccgcactcttcgcccaggtgcagcggggtgcccttccagcccctgacccggagctcgcagctgagatgtaccagaggggccgggctgtccttcgggaggctggcttccaccagtatgaggtctccaactttgcccggaatggggcgctcagtacccacaattggacttactggcagtgtggtcagtaccttggcgttgggcctggggcccatggacgatttatgccccagggggctggaggccacacccgggaggctcggatccagacactggagcctgacaactggatgaaggaggtgatgctgtttggccatggcacccggaagcgtgtccccctgggcaggctggagctgctggaggaagttttggccctggggctacgcaccgatgtggggatcactcaccagcactggcagcagtttgagccccagctgaccctgtgggatgtgtttggagcgaacaaggaggtgcaggagctgctggagcggggcctactgcagctggatcacaggggtcttcggtgttcctgggagggtctggctgtgctggactctctcttgctgaccctcctgcctcagctccaagaagcctggcagcagagaaccccctcccctgtgccaggaggatgacaaaaatgttcctgtgttccagggtaatgccaggtgggttttgagagctgggtcggtactgcagacatctcttctccgttgtcgggtgccgtctctgctccttgtggttattgctcagccctggcatccccaggggaatggcagcagtgaggtagatgggaggacatttctggtcagggaactggcatcccattcagcatctcaggactcacaggccaacatgtgttccatggctgggaattgcctaccacccacatcagcttctgtttacctttttggcatcaaataatgaacagtgtttggaaatctttctacaggcaattacctccccaagagaagccttccttattttggagtaaggtcctaagatagctggatgaatcaggaaaaccatgtcccctctaggtattattaatataagcaggaagggatctactataggaatgaagtatttataaaccactgaaagggatagagaagtgaacattggagaaagccagtagcaactgtgagaaatcagcaacttgcaggaggcacagaaaactcctgctgatggtctcagcttccagcagcacaaaagcagatgatgtactggaaaatgctcagaagatgctacaaaacctcatgcctactgtctgccactgctggagaaggaatcatggtttctagaagtgcctctcattagtggactttaaagcaaatcctggctggcaggaaattctgaggaatatagctcttaggcttccagcctctaccatgcaggagagaacacagaaggactgatgtatgttggtggatccatgtatgtgtccagcacagcggcctgctggactctgagaactgggaaagatcagagcaagccttgcctcttatcttcgggaaaccagaatatgtttggggtggtaggagccacacagactcttctgagccccctcactcacttccttccccctgtgcctttcctttgagagtgaaggtgggtggagttgaccagagaaaggggagagaattcgggaaagacccaaagtgtttgtaattcttctttgtccttttacctacagaaatggtcacatggttctatttaaatagcctaataaacacatctggagcctgt

SEQ ID NO: 454641 - DNA, 1120 bp, Homo sapiens
  misc_feature (905)..(905): n is a, c, g, or t
  misc_feature (925)..(925): n is a, c, g, or t
  misc_feature (941)..(941): n is a, c, g, or t
  misc_feature (943)..(943): n is a, c, g, or t
  misc_feature (971)..(971): n is a, c, g, or t
  misc_feature (978)..(978): n is a, c, g, or t
  misc_feature (995)..(996): n is a, c, g, or t
  misc_feature (999)..(999): n is a, c, g, or t
  misc_feature (1008)..(1009): n is a, c, g, or t
  misc_feature (1011)..(1011): n is a, c, g, or t
  misc_feature (1014)..(1014): n is a, c, g, or t
  misc_feature (1037)..(1037): n is a, c, g, or t
  misc_feature (1046)..(1046): n is a, c, g, or t
  misc_feature (1108)..(1108): n is a, c, g, or t
cacagtgatccctgcgcgcgtctcctgctcgggtcagtgcgccgcgctgcgctgggcgccatggcgctccccggagcccgggctcgcggctgggcggcagcagccagagcggcccagaggcgccgccgcgtggagaacgcaggagggtccccgagtcctgagcctgcgggccggcgcgcggcgctttacgtacactggccttactgcgagaagcgctgcagttactgcaacttcaacaagtacatccctcgccgcctggaggaggctgccatgcagaagtgtctggtgaccgaagctcagacgctgctgcggctcagcggggtgcaacgggtggagtctgtgttctttggtggggggacccccagtctagccagtccccacacggtggctgctgtcctggaggctgtggcacaggcagcccacctgcctgcagacttggaagtcacattggaggctaatcctacttcagctccgggctccagactggcagagttcggggcagcaggggttaacaggttgtctataggcctccagtccctagatgacactgagctccggctgttgggacggacgcactcggcctgcgatgctctgcggacgctggcagaggcccggcgcctctttcccgggcgcgtgtctgtagacttgatgctggggctgccggcacagcaggtggggccgtggcttgggcagctgcaggaactgctgcaccactgtgatgaccacctctccctctaccagctgtccctggagcggggcaccgcactcttcgcccaggtgcagcggggtgcccttccagcccctgacccggagctcgcagctgagatgtaccagaggggccgggctgtccttcgggaggctggcttccaccagtatgaggtctccaactttgcccggaatgggcncgcaggacccacaagggganggagggcaaggggggnangaccggggcggggggcgggggccagggnacagggnggcccaaaggggggganncanaacccgganngnggngcaaaaagggaacggaaaagggngaaaaaggnggggggggcaggcaccccaacgggcccgggcaacggaacgcggaaaaaggggccgcgcgacnccagggggggag

SEQ ID NO: 454642 - DNA, 438 bp, Homo sapiens
ctctagagcggccgcctactactactaaattcgcggccgcgtcgacgaggaatatagctcttaggcttccagcctctaccatgcaggagagaacacagaaggactgatgtatgttggtggatccatgtatgtgtccagcacagcggcctgctggactctgagaactgggaaagatcagagcaagccttgcctcttatcttcgggaaaccagaatatgtttggggtggtaggagccacacagactcttctgagccccctcactcacttccttccccctgtgcctttcctttgagagtgaaggtgggtggagttgaccagagaaaggggagagaattcgggaaagacccaaagtgtttgtaattcttctttgtccttttacctacagaaatggtcacatggttctatttaaatagcctaataaacacatctggagcctgt

SEQ ID NO: 454643 - DNA, 2689 bp, Homo sapiens
cacagtgatccctgcgcgcgtctcctgctcgggtcagtgcgccgcgctgcgctgggcgccatggcgctccccggagcccgggctcgcggctgggcggcagcagccagagcggcccagaggcgccgccgcgtggagaacgcaggagggtccccgagtcctgagcctgcgggccggcgcgcggcgctttacgtacactggccttactgcgagaagcgctgcagttactgcaacttcaacaagtacatccctcgccgcctggaggaggctgccatgcagaagtgtctggtgaccgaagctcagacgctgctgcggctcagcggggtgcaacgggtggagtctgtgttctttggtggggggacccccagtctagccagtccccacacggtggctgctgtcctggaggctgtggcacaggcagcccacctgcctgcagacttggaagtcacattggaggctaatcctacttcagctccgggctccagactggcagagttcggggcagcaggggttaacaggttgtctataggcctccagtccctagatgacactgagctccggctgttgggacggacgcactcggcctgcgatgctctgcggacgctggcagaggcccggcgcctctttcccgggcgcgtgtctgtagacttgatgctggggctgccggcacagcaggtggggccgtggcttgggcagctgcaggaactgctgcaccactgtgatgaccacctctccctctaccagctgtccctggagcggggcaccgcactcttcgcccaggtgcagcggggtgcccttccagcccctgacccggagctcgcagctgagatgtaccagaggggccgggctgtccttcgggaggctggcttccaccagtatgaggtctccaactttgcccggaatgtaagttctggggctgatggctggaggtggaggatgggcagactgcagtgtgaccagggcgttgtgaccttctgaagagaaggatcctggccgagatggtgggacattctaacctggggccccttacctgagtctaaaaatgaggcctgccctcttcactctgcactatttcctccctccccgcagggggcgctcagtacccacaattggacttactggcagtgtggtcagtaccttggcgttgggcctggggcccatggacgatttatgccccagggggctggaggccacacccgggaggctcggatccagacactggagcctgacaactggatgaaggaggtgatgctgtttggccatggcacccggaagcgtgtccccctgggcaggctggagctgctggaggaagttttggccctggggctacgcaccgatgtggggatcactcaccagcactggcagcagtttgagccccagctgaccctgtgggatgtgtttggagcgaacaaggaggtgcaggagctgctggagcggggcctactgcagctggatcacaggggtcttcggtgttcctgggagggtctggctgtgctggactctctcttgctgaccctcctgcctcagctccaagaagcctggcagcagagaaccccctcccctgtgccaggaggatgacaaaaatgttcctgtgttccagggtaatgccaggtgggttttgagagctgggtcggtactgcagacatctcttctccgttgtcgggtgccgtctctgctccttgtggttattgctcagccctggcatccccaggggaatggcagcagtgaggtagatgggaggacatttctggtcagggaactggcatcccattcagcatctcaggactcacaggccaacatgtgttccatggctgggaattgcctaccacccacatcagcttctgtttacctttttggcatcaaataatgaacagtgtttggaaatctttctacaggcaattacctccccaagagaagccttccttattttggagtaaggtcctaagatagctggatgaatcaggaaaaccatgtcccctctaggtattattaatataagcaggaagggatctactataggaatgaagtatttataaaccactgaaagggatagagaagtgaacattggagaaagccagtagcaactgtgagaaatcagcaacttgcaggaggcacagaaaactcctgctgatggtctcagcttccagcagcacaaaagcagatgatgtactggaaaatgctcagaagatgctacaaaacctcatgcctactgtctgccactgctggagaaggaatcatggtttctagaagtgcctctcattagtggactttaaagcaaatcctggctggcaggaaattctgaggaatatagctcttaggcttccagcctctaccatgcaggagagaacacagaaggactgatgtatgttggtggatccatgtatgtgtccagcacagcggcctgctggactctgagaactgggaaagatcagagcaagccttgcctcttatcttcgggaaaccagaatatgtttggggtggtaggagccacacagactcttctgagccccctcactcacttccttccccctgtgcctttcctttgagagtgaaggtgggtggagttgaccagagaaaggggagagaattcgggaaagacccaaagtgtttgtaattcttctttgtccttttacctacagaaatggtcacatggttctatttaaatagcctaataaacacatctggagcctgt

SEQ ID NO: 454644 - DNA, 2600 bp, Homo sapiens
cacagtgatccctgcgcgcgtctcctgctcgggtcagtgcgccgcgctgcgctgggcgccatggcgctccccggagcccgggctcgcggctgggcggcagcagccagagcggcccagaggcgccgccgcgtggagaacgcaggagggtccccgagtcctgagcctgcgggccggcgcgcggcgctttacgtacactggccttactgcgagaagcgctgcagttactgcaacttcaacaagtacatccctcgccgcctggaggaggctgccatgcagaagtgtctggtgaccgaagctcagacgctgctgcggctcagcggggtgcaacgggtggagtctgtgttctttggtggggggacccccagtctagccagtccccacacggtggctgctgtcctggaggctgtggcacaggcagcccacctgcctgcagacttggaagtcacattggaggctaatcctacttcagctccgggctccagactggcagagttcggggcagcaggggttaacaggttgtctataggcctccagtccctagatgacactgagctccggctgttgggacggacgcactcggcctgcgatgctctgcggacgctggcagaggcccggcgcctctttcccgggcgcgtgtctgtagacttgatgctggggctgccggcacagcaggtggggccgtggcttgggcagctgcaggaactgctgcaccactgtgatgaccacctctccctctaccagctgtccctggagcggggcaccgcactcttcgcccaggtgcagcggggtgcccttccagcccctgacccggagctcgcagctgagatgtaccagaggggccgggctgtccttcgggaggctggcttccaccagtatgaggtctccaactttgcccggaatggggcgctcagtacccacaattggacttactggcagtgtggtcagtaccttggcgttgggcctggggcccatggacgatttatgccccagggggctggaggccacacccgggaggctcggatccagacactggagcctgacaactggatgaaggaggtgatgctgtttggccatggcacccggaagcgtgtccccctgggcaggctggagctgctggaggaagttttggccctggggctacgcaccgatgtggggatcactcaccagcactggcagcagtttgagccccagctgaccctgtgggatgtgtttggagcgaacaaggaggtgcaggagctgctggagcggggcctactgcagctggatcacaggtgtgttggggggtgccgggcagagggggctgaggcataccagggagccctgactacagctctccacagacccaggagaagtgagaaagactgactggggtcttcggtgttcctgggagggtctggctgtgctggactctctcttgctgaccctcctgcctcagctccaagaagcctggcagcagagaaccccctcccctgtgccaggaggatgacaaaaatgttcctgtgttccagggtaatgccaggtgggttttgagagctgggtcggtactgcagacatctcttctccgttgtcgggtgccgtctctgctccttgtggttattgctcagccctggcatccccaggggaatggcagcagtgaggtagatgggaggacatttctggtcagggaactggcatcccattcagcatctcaggactcacaggccaacatgtgttccatggctgggaattgcctaccacccacatcagcttctgtttacctttttggcatcaaataatgaacagtgtttggaaatctttctacaggcaattacctccccaagagaagccttccttattttggagtaaggtcctaagatagctggatgaatcaggaaaaccatgtcccctctaggtattattaatataagcaggaagggatctactataggaatgaagtatttataaaccactgaaagggatagagaagtgaacattggagaaagccagtagcaactgtgagaaatcagcaacttgcaggaggcacagaaaactcctgctgatggtctcagcttccagcagcacaaaagcagatgatgtactggaaaatgctcagaagatgctacaaaacctcatgcctactgtctgccactgctggagaaggaatcatggtttctagaagtgcctctcattagtggactttaaagcaaatcctggctggcaggaaattctgaggaatatagctcttaggcttccagcctctaccatgcaggagagaacacagaaggactgatgtatgttggtggatccatgtatgtgtccagcacagcggcctgctggactctgagaactgggaaagatcagagcaagccttgcctcttatcttcgggaaaccagaatatgtttggggtggtaggagccacacagactcttctgagccccctcactcacttccttccccctgtgcctttcctttgagagtgaaggtgggtggagttgaccagagaaaggggagagaattcgggaaagacccaaagtgtttgtaattcttctttgtccttttacctacagaaatggtcacatggttctatttaaatagcctaataaacacatctggagcctgt

SEQ ID NO: 454645 - DNA, 2298 bp, Homo sapiens
cacagtgatccctgcgcgcgtctcctgctcgggtcagtgcgccgcgctgcgctgggcgccatggcgctccccggagcccgggctcgcggctgggcggcagcagccagagcggcccagaggcgccgccgcgtggagaacgcaggagggtccccgagtcctgagcctgcgggccggcgcgcggcgctttacgtacactggccttactgcgagaagcgctgcagttactgcaacttcaacaagtacatccctcgccgcctggaggaggctgccatgcagaagtgtctggtgaccgaagctcagacgctgctgcggctcagcggggtgcaacgtccctagatgacactgagctccggctgttgggacggacgcactcggcctgcgatgctctgcggacgctggcagaggcccggcgcctctttcccgggcgcgtgtctgtagacttgatgctggggctgccggcacagcaggtggggccgtggcttgggcagctgcaggaactgctgcaccactgtgatgaccacctctccctctaccagctgtccctggagcggggcaccgcactcttcgcccaggtgcagcggggtgcccttccagcccctgacccggagctcgcagctgagatgtaccagaggggccgggctgtccttcgggaggctggcttccaccagtatgaggtctccaactttgcccggaatggggcgctcagtacccacaattggacttactggcagtgtggtcagtaccttggcgttgggcctggggcccatggacgatttatgccccagggggctggaggccacacccgggaggctcggatccagacactggagcctgacaactggatgaaggaggtgatgctgtttggccatggcacccggaagcgtgtccccctgggcaggctggagctgctggaggaagttttggccctggggctacgcaccgatgtggggatcactcaccagcactggcagcagtttgagccccagctgaccctgtgggatgtgtttggagcgaacaaggaggtgcaggagctgctggagcggggcctactgcagctggatcacaggggtcttcggtgttcctgggagggtctggctgtgctggactctctcttgctgaccctcctgcctcagctccaagaagcctggcagcagagaaccccctcccctgtgccaggaggatgacaaaaatgttcctgtgttccagggtaatgccaggtgggttttgagagctgggtcggtactgcagacatctcttctccgttgtcgggtgccgtctctgctccttgtggttattgctcagccctggcatccccaggggaatggcagcagtgaggtagatgggaggacatttctggtcagggaactggcatcccattcagcatctcaggactcacaggccaacatgtgttccatggctgggaattgcctaccacccacatcagcttctgtttacctttttggcatcaaataatgaacagtgtttggaaatctttctacaggcaattacctccccaagagaagccttccttattttggagtaaggtcctaagatagctggatgaatcaggaaaaccatgtcccctctaggtattattaatataagcaggaagggatctactataggaatgaagtatttataaaccactgaaagggatagagaagtgaacattggagaaagccagtagcaactgtgagaaatcagcaacttgcaggaggcacagaaaactcctgctgatggtctcagcttccagcagcacaaaagcagatgatgtactggaaaatgctcagaagatgctacaaaacctcatgcctactgtctgccactgctggagaaggaatcatggtttctagaagtgcctctcattagtggactttaaagcaaatcctggctggcaggaaattctgaggaatatagctcttaggcttccagcctctaccatgcaggagagaacacagaaggactgatgtatgttggtggatccatgtatgtgtccagcacagcggcctgctggactctgagaactgggaaagatcagagcaagccttgcctcttatcttcgggaaaccagaatatgtttggggtggtaggagccacacagactcttctgagccccctcactcacttccttccccctgtgcctttcctttgagagtgaaggtgggtggagttgaccagagaaaggggagagaattcgggaaagacccaaagtgtttgtaattcttctttgtccttttacctacagaaatggtcacatggttctatttaaatagcctaataaacacatctggagcctgt

SEQ ID NO: 454646 - DNA, 1945 bp, Homo sapiens
tggttgctctagagtatcccctatggcgcctaggtgcagcggggtgcccttccagcccctgacccggagctcgcagctgagatgtaccagaggggccgggctgtccttcgggaggctggcttccaccagtatgaggtctccaactttgcccggaatgtaagttctggggctgatggctggaggtggaggatgggcagactgcagtgtgaccagggcgttgtgaccttctgaagagaaggatcctggccgagatggtgggacattctaacctggggccccttacctgagtctaaaaatgaggcctgccctcttcactctgcactatttcctccctccccgcagggggcgctcagtacccacaattggacttactggcagtgtggtcagtaccttggcgttgggcctggggcccatggacgatttatgccccagggggctggaggccacacccgggaggctcggatccagacactggagcctgacaactggatgaaggaggtgatgctgtttggccatggcacccggaagcgtgtccccctgggcaggctggagctgctggaggaagttttggccctggggctacgcaccgatgtggggatcactcaccagcactggcagcagtttgagccccagctgaccctgtgggatgtgtttggagcgaacaaggaggtgcaggagctgctggagcggggcctactgcagctggatcacaggggtcttcggtgttcctgggagggtctggctgtgctggactctctcttgctgaccctcctgcctcagctccaagaagcctggcagcagagaaccccctcccctgtgccaggaggatgacaaaaatgttcctgtgttccagggtaatgccaggtgggttttgagagctgggtcggtactgcagacatctcttctccgttgtcgggtgccgtctctgctccttgtggttattgctcagccctggcatccccaggggaatggcagcagtgaggtagatgggaggacatttctggtcagggaactggcatcccattcagcatctcaggactcacaggccaacatgtgttccatggctgggaattgcctaccacccacatcagcttctgtttacctttttggcatcaaataatgaacagtgtttggaaatctttctacaggcaattacctccccaagagaagccttccttattttggagtaaggtcctaagatagctggatgaatcaggaaaaccatgtcccctctaggtattattaatataagcaggaagggatctactataggaatgaagtatttataaaccactgaaagggatagagaagtgaacattggagaaagccagtagcaactgtgagaaatcagcaacttgcaggaggcacagaaaactcctgctgatggtctcagcttccagcagcacaaaagcagatgatgtactggaaaatgctcagaagatgctacaaaacctcatgcctactgtctgccactgctggagaaggaatcatggtttctagaagtgcctctcattagtggactttaaagcaaatcctggctggcaggaaattctgaggaatatagctcttaggcttccagcctctaccatgcaggagagaacacagaaggactgatgtatgttggtggatccatgtatgtgtccagcacagcggcctgctggactctgagaactgggaaagatcagagcaagccttgcctcttatcttcgggaaaccagaatatgtttggggtggtaggagccacacagactcttctgagccccctcactcacttccttccccctgtgcctttcctttgagagtgaaggtgggtggagttgaccagagaaaggggagagaattcgggaaagacccaaagtgtttgtaattcttctttgtccttttacctacagaaatggtcacatggttctatttaaatagcctaataaacacatctggagcctgt

SEQ ID NO: 454647 - DNA, 1749 bp, Homo sapiens
ctcaattttctgagctctgtgaagcaatagatagataaagggtttccacttgtttttagggagcactgaaacctctcataggaagcacagtagataattatcaagcaaatccagagctgctctggataaagcagagccataaagccctggctagagctggctgagaggggagggaagagaggaggcatagaggaaggcctggcttggctggaagctgggttccagtctcagtggaataggagtgaagctgccctcctccctgctggcccattggcctggttctgctttcatgcatgtcagctgctgagatctccatgctgaactggaccctcccccacctctcaccataccccaactatgtggcccagagtagccaggccagctccccacctctgaccctctggcttccccagcactggcagcagtttgagccccagctgaccctgtgggatgtgtttggagcgaacaaggaggtgcaggagctgctggagcggggcctactgcagctggatcacaggggtcttcggtgttcctgggagggtctggctgtgctggactctctcttgctgaccctcctgcctcagctccaagaagcctggcagcagagaaccccctcccctgtgccaggaggatgacaaaaatgttcctgtgttccagggtaatgccaggtgggttttgagagctgggtcggtactgcagacatctcttctccgttgtcgggtgccgtctctgctccttgtggttattgctcagccctggcatccccaggggaatggcagcagtgaggtagatgggaggacatttctggtcagggaactggcatcccattcagcatctcaggactcacaggccaacatgtgttccatggctgggaattgcctaccacccacatcagcttctgtttacctttttggcatcaaataatgaacagtgtttggaaatctttctacaggcaattacctccccaagagaagccttccttattttggagtaaggtcctaagatagctggatgaatcaggaaaaccatgtcccctctaggtattattaatataagcaggaagggatctactataggaatgaagtatttataaaccactgaaagggatagagaagtgaacattggagaaagccagtagcaactgtgagaaatcagcaacttgcaggaggcacagaaaactcctgctgatggtctcagcttccagcagcacaaaagcagatgatgtactggaaaatgctcagaagatgctacaaaacctcatgcctactgtctgccactgctggagaaggaatcatggtttctagaagtgcctctcattagtggactttaaagcaaatcctggctggcaggaaattctgaggaatatagctcttaggcttccagcctctaccatgcaggagagaacacagaaggactgatgtatgttggtggatccatgtatgtgtccagcacagcggcctgctggactctgagaactgggaaagatcagagcaagccttgcctcttatcttcgggaaaccagaatatgtttggggtggtaggagccacacagactcttctgagccccctcactcacttccttccccctgtgcctttcctttgagagtgaaggtgggtggagttgaccagagaaaggggagagaattcgggaaagacccaaagtgtttgtaattcttctttgtccttttacctacagaaatggtcacatggttctatttaaatagcctaataaacacatctggagcctgt

SEQ ID NO: 454648 - DNA, 971 bp, Homo sapiens
caaaagcagatgatgtactggaaaatgctcagaagatgctacaaaacctcatgcctactgtctgccactgctggagaaggaatcatggtttctagaattgcctaccacccacatcagcttctgtttacctttttggcatcaaataatgaacagtgtttggaaatctttctacaggcaattacctccccaagagaagccttccttattttggagtaaggtcctaagatagctggatgaatcaggaaaaccatgtcccctctaggtattattaatataagcaggaagggatctactataggaatgaagtatttataaaccactgaaagggatagagaagtgaacattggagaaagccagtagcaactgtgagaaatcagcaacttgcaggaggcacagaaaactcctgctgatggtctcagcttccagcagcacaaaagcagatgatgtactggaaaatgctcagaagatgctacaaaacctcatgcctactgtctgccactgctggagaaggaatcatggtttctagaagtgcctctcattagtggactttaaagcaaatcctggctggcaggaaattctgaggaatatagctcttaggcttccagcctctaccatgcaggagagaacacagaaggactgatgtatgttggtggatccatgtatgtgtccagcacagcggcctgctggactctgagaactgggaaagatcagagcaagccttgcctcttatcttcgggaaaccagaatatgtttggggtggtaggagccacacagactcttctgagccccctcactcacttccttccccctgtgcctttcctttgagagtgaaggtgggtggagttgaccagagaaaggggagagaattcgggaaagacccaaagtgtttgtaattcttctttgtccttttacctacagaaatggtcacatggttctatttaaatagcctaataaacacatctggagcctgt

SEQ ID NO: 454649 - DNA, 1617 bp, Homo sapiens
cacagtgatccctgcgcgcgtctcctgctcgggtcagtgcgccgcgctgcgctgggcgccatggcgctccccggagcccgggctcgcggctgggcggcagcagccagagcggcccagaggcgccgccgcgtggagaacgcaggagggtccccgagtcctgagcctgcgggccggcgcgcggcgctttacgtacactggccttactgcgagaagcgctgcagttactgcaacttcaacaagtacatccctcgccgcctggaggaggctgccatgcagaagtgtctggtgaccgaagctcagacgctgctgcggctcagcggggtgcaacgggtggagtctgtgttctttggtggggggacccccagtctagccagtccccacacggtggctgctgtcctggaggctgtggcacaggcagcccacctgcctgcagacttggaagtcacattggaggctaatcctacttcagctccgggctccagactggcagagttcggggcagcaggggttaacaggttgtctataggcctccagtccctagatgacactgagctccggctgttgggacggacgcactcggcctgcgatgctctgcggacgctggcagaggcccggcgcctctttcccgggcgcgtgtctgtagacttgatgctggggctgccggcacagcaggtggggccgtggcttgggcagctgcaggaactgctgcaccactgtgatgaccacctctccctctaccagctgtccctggagcggggcaccgcactcttcgcccaggtgcagcggggtgcccttccagcccctgacccggagctcgcagctgagatgtaccagaggggccgggctgtccttcgggaggctggcttccaccagtatgaggtctccaactttgcccggaatgtaagttctggggctgatggctggaggtggaggatgggcagactgcagtgtgaccagggcgttgtgaccttctgaagagaaggatcctggccgagatggtgggacattctaacctggggccccttacctgagtctaaaaatgaggcctgccctcttcactctgcactatttcctccctccccgcagggggcgctcagtacccacaattggacttactggcagtgtggtcagtaccttggcgttgggcctggtgagtcccgtgaactacagaaagggtgactcaggagaggaatgtcgtggctgtgtgaacttgggccacattaacctctccaagcctctattttctcatatgtaaaatgtggcaaaaaataatacctccctatagaactgttgagcatgaattataaggggcttaatgttgcaccttgcactagggttctcagcctttagtgtgtatgagaatctcctggagggcttgttaaaacccaagctgctgggccccaccctcagaattcccaattggacagggctagaggagagcccaagaatttatatgtcttggcattttgggatagatgattaaaaaaaaaagaaaaagaaaaaagggcctggtgtcatgtgcctctaatctgagctacttgggaagctgaggtggaaagatcgtttgaccccaggcgtccaagaccagcctgggcagtatagtgagacaccacctca

SEQ ID NO: 454650 - DNA, 1012 bp, Homo sapiens
  misc_feature (923)..(923): n is a, c, g, or t
  misc_feature (929)..(929): n is a, c, g, or t
  misc_feature (944)..(944): n is a, c, g, or t
  misc_feature (994)..(994): n is a, c, g, or t
cacagtgatccctgcgcgcgtctcctgctcgggtcagtgcgccgcgctgcgctgggcgccatggcgctccccggagcccgggctcgcggctgggcggcagcagccagagcggcccagaggcgccgccgcgtggagaacgcaggagggtccccgagtcctgagcctgcgggccggcgcgcggcgctttacgtacactggccttactgcgagaagcgctgcagttactgcaacttcaacaagtacatccctcgccgcctggaggaggctgccatgcagaagtgtctggtgaccgaagctcagacgctgctgcggctcagcggggtgcaacgggtggagtctgtgttctttggtggggggacccccagtctagccagtccccacacggtggctgctgtcctggaggctgtggcacaggcagcccacctgcctgcagacttggaagtcacattggaggctaatcctacttcagctccgggctccagactggcagagttcggggcagcaggggttaacaggttgtctataggcctccagtccctagatgacactgagctccggctgttgggacggacgcactcggcctgcgatgctctgcggacgctggcagaggcccggcgcctctttcccgggcgcgtgtctgtagacttgatgctggggctgccggcacagcaggtggggccgtggcttgggcagctgcaggaactgctgcaccactgtgatgaccacctctccctctaccagctgtccctggagcggggcaccgcactcttcgcccaggtgcagcggggtgcccttccagcccctgacccggagctcgcagctgagatgtaccagaggggccgggctgtccttcgggaggctggcttccaccagtatgaggtctccaactttgcccggaatgggcgctcataccacattgactnctggcntgtgtcatacttgcnttggctgggcatggacattatgcccagggctggagcacaccggaggtggncaaaatggactgaactga

SEQ ID NO: 454651 - DNA, 2447 bp, Homo sapiens
cacagtgatccctgcgcgcgtctcctgctcgggtcagtgcgccgcgctgcgctgggcgccatggcgctccccggagcccgggctcgcggctgggcggcagcagccagagcggcccagaggcgccgccgcgtggagaacgcaggagggtccccgagtcctgagcctgcgggccggcgcgcggcgctttacgtacactggccttactgcgagaagcgctgcagttactgcaacttcaacaagtacatccctcgccgcctggaggaggctgccatgcagaagtgtctggtgaccgaagctcagacgctgctgcggctcagcggggtgcaacgggtggagtctgtgttctttggtggggggacccccagtctagccagtccccacacggtggctgctgtcctggaggctgtggcacaggcagcccacctgcctgcagacttggaagtcacattggaggctaatcctacttcagctccgggctccagactggcagagttcggggcagcaggggttaacaggttgtctataggcctccagtccctagatgacactgagctccggctgttgggacggacgcactcggcctgcgatgctctgcggacgctggcagaggcccggcgcctctttcccgggcgcgtgtctgtagacttgatgctggggctgccggcacagcaggtggggccgtggcttgggcagctgcaggaactgctgcaccactgtgatgaccacctctccctctaccagctgtccctggagcggggcaccgcactcttcgcccaggtgcagcggggtgcccttccagcccctgacccggagctcgcagctgagatgtaccagaggggccgggctgtccttcgggaggctggcttccaccagtatgaggtctccaactttgcccggaatggggcgctcagtacccacaattggacttactggcagtgtggtcagtaccttggcgttgggcctggggcccatggacgatttatgccccagggggctggaggccacacccgggaggctcggatccagacactggagcctgacaactggatgaaggaggctggaggaagttttggccctggggctacgcaccgatgtggggatcactcaccagcactggcagcagtttgagccccagctgaccctgtgggatgtgtttggagcgaacaaggaggtgcaggagctgctggagcggggcctactgcagctggatcacaggggtcttcggtgttcctgggagggtctggctgtgctggactctctcttgctgaccctcctgcctcagctccaagaagcctggcagcagagaaccccctcccctgtgccaggaggatgacaaaaatgttcctgtgttccagggtaatgccaggtgggttttgagagctgggtcggtactgcagacatctcttctccgttgtcgggtgccgtctctgctccttgtggttattgctcagccctggcatccccaggggaatggcagcagtgaggtagatgggaggacatttctggtcagggaactggcatcccattcagcatctcaggactcacaggccaacatgtgttccatggctgggaattgcctaccacccacatcagcttctgtttacctttttggcatcaaataatgaacagtgtttggaaatctttctacaggcaattacctccccaagagaagccttccttattttggagtaaggtcctaagatagctggatgaatcaggaaaaccatgtcccctctaggtattattaatataagcaggaagggatctactataggaatgaagtatttataaaccactgaaagggatagagaagtgaacattggagaaagccagtagcaactgtgagaaatcagcaacttgcaggaggcacagaaaactcctgctgatggtctcagcttccagcagcacaaaagcagatgatgtactggaaaatgctcagaagatgctacaaaacctcatgcctactgtctgccactgctggagaaggaatcatggtttctagaagtgcctctcattagtggactttaaagcaaatcctggctggcaggaaattctgaggaatatagctcttaggcttccagcctctaccatgcaggagagaacacagaaggactgatgtatgttggtggatccatgtatgtgtccagcacagcggcctgctggactctgagaactgggaaagatcagagcaagccttgcctcttatcttcgggaaaccagaatatgtttggggtggtaggagccacacagactcttctgagccccctcactcacttccttccccctgtgcctttcctttgagagtgaaggtgggtggagttgaccagagaaaggggagagaattcgggaaagacccaaagtgtttgtaattcttctttgtccttttacctacagaaatggtcacatggttctatttaaatagcctaataaacacatctggagcctgt

SEQ ID NO: 454652 - DNA, 2318 bp, Homo sapiens
ataggctaggtacgaggcgggtgttgaatcggccgaggactgcaacttcaacaagtacatccctcgccgcctggaggaggctgccatgcagaagtgtctggtgaccgaagctcagacgctgctgcggctcagcggggtgcaacgggtggagtctgtgttctttggtggggggacccccagtctagccagtccccacacggtggctgctgtcctggaggctgtggcacaggcagcccacctgcctgcagacttggaagtcacattggaggctaatcctacttcagctccgggctccagactggcagagttcggggcagcaggggttaacaggttgtctataggcctccagtccctagatgacactgagctccggctgttgggacggacgcactcggcctgcgatgctctgcggacgctggcagaggcccggcgcctctttcccgggcgcgtgtctgtagacttgatgctggggctgccggcacagcaggtggggccgtggcttgggcagctgcaggaactgctgcaccactgtgatgaccacctctccctctaccagctgtccctggagcggggcaccgcactcttcgcccaggtgcagcggggtgcccttccagcccctgacccggagctcgcagctgagatgtaccagaggggccgggctgtccttcgggaggctggcttccaccagtatgaggtctccaactttgcccggaatggggcgctcagtacccacaattggacttactggcagtgtggtcagtaccttggcgttgggcctggggcccatggacgatttatgccccagggggctggaggccacacccgggaggctcggatccagacactggagcctgacaactggatgaaggaggtgatgctgtttggccatggcacccggaagcgtgtccccctgggcaggctggagctgctggaggaagttttggccctggggctacgcaccgatgtggggatcactcaccagcactggcagcagtttgagccccagctgaccctgtgggatgtgtttggagcgaacaaggaggtgcaggagctgctggagcggggcctactgcagctggatcacaggggtcttcggtgttcctgggagggtctggctgtgctggactctctcttgctgaccctcctgcctcagctccaagaagcctggcagcagagaaccccctcccctgtgccaggaggatgacaaaaatgttcctgtgttccagggtaatgccaggtgggttttgagagctgggtcggtactgcagacatctcttctccgttgtcgggtgccgtctctgctccttgtggttattgctcagccctggcatccccaggggaatggcagcagtgaggtagatgggaggacatttctggtcagggaactggcatcccattcagcatctcaggactcacaggccaacatgtgttccatggctgggaattgcctaccacccacatcagcttctgtttacctttttggcatcaaataatgaacagtgtttggaaatctttctacaggcaattacctccccaagagaagccttccttattttggagtaaggtcctaagatagctggatgaatcaggaaaaccatgtcccctctaggtattattaatataagcaggaagggatctactataggaatgaagtatttataaaccactgaaagggatagagaagtgaacattggagaaagccagtagcaactgtgagaaatcagcaacttgcaggaggcacagaaaactcctgctgatggtctcagcttccagcagcacaaaagcagatgatgtactggaaaatgctcagaagatgctacaaaacctcatgcctactgtctgccactgctggagaaggaatcatggtttctagaagtgcctctcattagtggactttaaagcaaatcctggctggcaggaaattctgaggaatatagctcttaggcttccagcctctaccatgcaggagagaacacagaaggactgatgtatgttggtggatccatgtatgtgtccagcacagcggcctgctggactctgagaactgggaaagatcagagcaagccttgcctcttatcttcgggaaaccagaatatgtttggggtggtaggagccacacagactcttctgagccccctcactcacttccttccccctgtgcctttcctttgagagtgaaggtgggtggagttgaccagagaaaggggagagaattcgggaaagacccaaagtgtttgtaattcttctttgtccttttacctacagaaatggtcacatggttctatttaaatagcctaataaacacatctggagcctgt

SEQ ID NO: 454653 - DNA, 2125 bp, Homo sapiens
cacagtgatccctgcgcgcgtctcctgctcgggtcagtgcgccgcgctgcgctgggcgccatggcgctccccggagcccgggctcgcggctgggcggcagcagccagagcggcccagaggcgccgccgcgtggagaacgcaggagggtccccgagtcctgagcctgcgggccggcgcgcggcgctttacgtacactggccttactgcgagaagcgctgcagttactgcaacttcaacaagtacatccctcgccgcctggaggaggctgccatgcagaagtgtctggtgaccgaagctcagacgctgctgcggctcagcggggtgcaacgggtggagtctgtgttctttggtggggggacccccagtctagccagtccccacacggtggctgctgtcctggaggctgtggcacaggcagcccacctgcctgcagacttggaagtcacattggaggctaatcctacttcagctccgggctccagactggcagagttcggggcagcaggggttaacaggttgtctataggcctccagtccctagatgacactgagctccggctgttgggacggacgcactcggcctgcgatgctctgcggacgctggcagaggcccggcgcctctttcccgggcgcgtgtctgtagacttgatgctggggctgccggcacagcaggtggggccgtggcttgggcagctgcaggaactgctgcaccactgtgatgaccacctctccctctaccagctgtccctggagcggggcaccgcactcttcgcccaggtgcagcggggtgcccttccagcccctgacccggagctcgcagctgaggatgtgtttggagcgaacaaggaggtgcaggagctgctggagcggggcctactgcagctggatcacaggggtcttcggtgttcctgggagggtctggctgtgctggactctctcttgctgaccctcctgcctcagctccaagaagcctggcagcagagaaccccctcccctgtgccaggaggatgacaaaaatgttcctgtgttccagggtaatgccaggtgggttttgagagctgggtcggtactgcagacatctcttctccgttgtcgggtgccgtctctgctccttgtggttattgctcagccctggcatccccaggggaatggcagcagtgaggtagatgggaggacatttctggtcagggaactggcatcccattcagcatctcaggactcacaggccaacatgtgttccatggctgggaattgcctaccacccacatcagcttctgtttacctttttggcatcaaataatgaacagtgtttggaaatctttctacaggcaattacctccccaagagaagccttccttattttggagtaaggtcctaagatagctggatgaatcaggaaaaccatgtcccctctaggtattattaatataagcaggaagggatctactataggaatgaagtatttataaaccactgaaagggatagagaagtgaacattggagaaagccagtagcaactgtgagaaatcagcaacttgcaggaggcacagaaaactcctgctgatggtctcagcttccagcagcacaaaagcagatgatgtactggaaaatgctcagaagatgctacaaaacctcatgcctactgtctgccactgctggagaaggaatcatggtttctagaagtgcctctcattagtggactttaaagcaaatcctggctggcaggaaattctgaggaatatagctcttaggcttccagcctctaccatgcaggagagaacacagaaggactgatgtatgttggtggatccatgtatgtgtccagcacagcggcctgctggactctgagaactgggaaagatcagagcaagccttgcctcttatcttcgggaaaccagaatatgtttggggtggtaggagccacacagactcttctgagccccctcactcacttccttccccctgtgcctttcctttgagagtgaaggtgggtggagttgaccagagaaaggggagagaattcgggaaagacccaaagtgtttgtaattcttctttgtccttttacctacagaaatggtcacatggttctatttaaatagcctaataaacacatctggagcctgt

SEQ ID NO: 454654 - DNA, 1846 bp, Homo sapiens
ctcaattttctgagctctgtgaagcaatagatagataaagggtttccacttgtttttagggagcactgaaacctctcataggaagcacagtagataattatcaagcaaatccagagctgctctggataaagcagagccataaagccctggctagagctggctgagaggggagggaagagaggaggcatagaggaaggcctggcttggctggaagctgggttccagtctcagtggaataggagtgaagctgccctcctccctgctggcccattggcctggttctgctttcatgcatgtcagctgctgagatctccatgctgaactggaccctcccccacctctcaccataccccaactatgtggcccagagtagccaggccagctccccacctctgaccctctggcttccccagcactggcagcagtttgagccccagctgaccctgtgggatgtgtttggagcgaacaaggaggtgcaggagctgctggagcggggcctactgcagctggatcacaggtgtgttggggggtgccgggcagagggggctgaggcataccagggagccctgactacagctctccacagacccaggagaagtgagaaagactgactggggtcttcggtgttcctgggagggtctggctgtgctggactctctcttgctgaccctcctgcctcagctccaagaagcctggcagcagagaaccccctcccctgtgccaggaggatgacaaaaatgttcctgtgttccagggtaatgccaggtgggttttgagagctgggtcggtactgcagacatctcttctccgttgtcgggtgccgtctctgctccttgtggttattgctcagccctggcatccccaggggaatggcagcagtgaggtagatgggaggacatttctggtcagggaactggcatcccattcagcatctcaggactcacaggccaacatgtgttccatggctgggaattgcctaccacccacatcagcttctgtttacctttttggcatcaaataatgaacagtgtttggaaatctttctacaggcaattacctccccaagagaagccttccttattttggagtaaggtcctaagatagctggatgaatcaggaaaaccatgtcccctctaggtattattaatataagcaggaagggatctactataggaatgaagtatttataaaccactgaaagggatagagaagtgaacattggagaaagccagtagcaactgtgagaaatcagcaacttgcaggaggcacagaaaactcctgctgatggtctcagcttccagcagcacaaaagcagatgatgtactggaaaatgctcagaagatgctacaaaacctcatgcctactgtctgccactgctggagaaggaatcatggtttctagaagtgcctctcattagtggactttaaagcaaatcctggctggcaggaaattctgaggaatatagctcttaggcttccagcctctaccatgcaggagagaacacagaaggactgatgtatgttggtggatccatgtatgtgtccagcacagcggcctgctggactctgagaactgggaaagatcagagcaagccttgcctcttatcttcgggaaaccagaatatgtttggggtggtaggagccacacagactcttctgagccccctcactcacttccttccccctgtgcctttcctttgagagtgaaggtgggtggagttgaccagagaaaggggagagaattcgggaaagacccaaagtgtttgtaattcttctttgtccttttacctacagaaatggtcacatggttctatttaaatagcctaataaacacatctggagcctgt

SEQ ID NO: 454655 - DNA, 2116 bp, Homo sapiens
  misc_feature (1886)..(1886): n is a, c, g, or t
tttttttcaaattgtggacatcaaaaatgcagcctcatcattttcaaatgcctgtttaaggaaacatgtttattcagttttaaagcttcataacttgtagccttagagtttgcatctttcctggcatttctccgcactgtggtgtcaaggaaagagcatggctttcatgtcagacacatctgcaatcagatcctggctcagtcaacatgcattattagctcagtgtggctgtgtcagcttacttggctgctcttagccacaggttcttcctcttctaaacctcaggagattggtgaattcagtgaaaaaatgcatgtcaggccaccagcacagcatatggcaaatgacaccctcactaaacagtgatttttccttccctcttattctgcttgatagaattaaattatctttaaggtctgtgagtaatgtctgtttgtgtaattaagataggagtatttttataagattgtaatgacatgaaagaaactttccccattcccatagtgtctttaatttgctttaaaacacttgaattagtgaaaaagccagttatttattcgaatactataattttctcaaagaatgatcaccattttaagattaattccaatgttctttttcatatctaaataatgttggcatactactgacaagagaaacaagacaaatgtgagagatgtctgcgtttctcctattaataatattacaattggatgttagggtgcaggttaaatagcttttctttaattatattacaattgaatgttagggggcaagataaatagattttctctcaggttgataccctcctttaagtgaatgtgattaactgttgtttcatgttaatgagcattaagtcaagccagtaaaactgatctatttatagagcaaggagaaaatgtgtcatgaaatttggaacttaacagagatgtaatttgcttttttgcacagatgttgatgagtgtgcagaaaacataaacctctgtgagaacggacagtgccttaatgtcccgggtgcatatcgctgcgagtgtgagatgggcttcactccagcctcagacagcagatcctgccaaggtgggtcaccaggattccaactcattttcaagttggatcaaccacagtaaatgaaaccacaacaagggctggaacaagctccacctggaagcagaatacatagcacatgctgcactataaaagtcattcgtttaagcgtggattattttgccgaatgaataatgatgatggcggctttcatctcttatgaagttttcctggccaagagccagtagttggaagtttggatcattcttttttcttttttaaccatttcttctcttctttctcttttttatcactaaatgaatgacatgtggagaaactattcagcttttaaagtatgctccattacttgtctcaactaccactatttattgtgtttatcaaaatcataaaaagctcatttttggcatttaccttcgtggttgagactgctgtctgtatgtctgggaatggaagtcctcttcagggattcagcaagggctgtacttttgcttaatactagtggttccttattctaagtgatgacatcatccacctttcctagaaatgggtctttgtgcctagtatgatatctttccaagaaaaagaatttggattttctattaaattagaaactcaattcacattatatatagtttgagccatcattgtgttatgaatagggactatatgaaaatataaatgaagaaaggagagattgaaaataatttatacaccatagggcttcagtagaatttatgattcacagaaaacctttaaaaaaactcagtttgggccaggcgtggtggctcacgcctatattcccagctctttgggaggccgangcaggtggatcacctgaggttgggagttcaagaccagcctgaacaacatggagaaactccatctctactaaaaatacaaaattagctgggtatggtggctcatgcctgtaatcccagctactcaggaggcagaggcaggaaaattgcttgaaccctggaggcggaggttgcggtgagccaagattgcgccattgcactacagactggacaacaagagcgaaactcagtct

SEQ ID NO: 454656 - DNA, 10433 bp, Homo sapiens
atggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaactcagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaagatataaatgaatgtgaaagcaacccatgtgtcaatggggcctgcagaaacaaccttggatctttcaattgtgaatgttcgcccggcagcaaactcagctccacaggattgatctgtattgacagcctgaaggggacctgttggctcaacatccaggacagccgctgtgaggtgaatattaatggagccactctgaaatctgaatgctgtgccaccctcggagccgcctgggggagcccctgtgagcggtgtgaactagatacagcttgcccaagagggcttgccaggattaaaggtgttacgtgtgaagatgttaatgagtgtgaggtgttccctggcgtttgtccaaatggacgctgtgtcaacagtaagggatcttttcattgcgagtgccctgaaggccttacgttggatgggactggccgtgtatgtttggatattcgcatggagcagtgttacttgaagtgggatgaagatgaatgcatccaccccgttcctggaaagttccgcatggatgcctgctgctgtgctgtcggggcggcttggggcaccgagtgtgaggagtgccccaaacctggcaccaaggaatacgagacactgtgcccccgcggggctggctttgctaaccgaggggatgttcttactgggcggccattttacaaagacatcaatgaatgcaaagcatttcctgggatgtgcacttatgggaagtgcagaaatacaatcggaagcttcaaatgccgttgcaatagtggctttgctctagacatggaggaaagaaactgcacggacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaagatattgatgaatgctccttccaaaacatttgtgtctctggaacatgtaataacctgcctggaatgtttcattgcatctgcgatgatggttatgaattggacagaacaggagggaactgtacagatattgatgagtgtgcagatcctataaactgtgtcaatggcctatgtgtcaacacgcctggtcgctatgagtgtaactgcccacccgattttcagttgaacccaactggtgtgggttgtgttgacaaccgtgtgggcaactgctacctgaagtttggacctcgaggagatgggagtctgtcttgcaacaccgagatcggggtgggcgtcagtcgctcttcatgctgctgctctctgggaaaggcctggggaaacccctgtgagacatgcccccctgtcaatagcactgaatattacaccctgtgtcccggaggtgaaggcttcagacctaaccccatcacaatcattttagaagacattgacgaatgccaggagttaccaggtctctgccagggtggaaactgcatcaacacttttgggagcttccagtgtgagtgcccacaaggctactacctcagcgaggatacccgcatctgtgaggatattgatgagtgttttgcacatcctggtgtgtgtgggcctgggacctgctataacaccctgggaaattacacctgcatttgcccacctgagtacatgcaggtcaatggaggccacaactgcatggacatgagaaaaagcttttgctaccgaagctataatggaaccacttgtgagaatgagttgcctttcaatgtgacaaaaaggatgtgctgctgcacatataatgtgggcaaagcttggaacaaaccttgtgaaccatgcccaactccaggaacagctgactttaaaaccatatgtggaaatattcctggattcacctttgacattcacacaggaaaagctgttgacattgatgaatgtaaagagattccaggcatttgtgcaaatggtgtgtgcattaaccagattggcagtttccgctgtgaatgccctacaggattcagttacaatgacctgctgttggtttgtgaagatatagatgagtgcagcaatggtgataatctctgccagcggaatgcagactgcatcaatagtcctggtagttaccgctgtgaatgtgccgcgggtttcaaactttcacccaatggggcctgtgtagatcgcaatgaatgtttagaaattcctaacgtttgcagtcatggcttgtgtgttgatctgcaaggaagttaccagtgcatctgccacaatggctttaaggcttctcaggaccagaccatgtgcatggatgttgatgagtgcgagcggcatccatgtggaaatggaacttgtaaaaacaccgttggatcctataactgtctgtgctacccagggtttgaactcactcataataatgattgcctggacatagatgagtgcagttccttttttggtcaggtgtgcagaaatggacgttgttttaatgaaattggttctttcaagtgtctatgtaacgaaggttatgaacttaccccagatggcaaaaactgtatagacactaatgagtgtgtcgcccttcccggctcttgctctcctggtacctgtcagaatttggagggatccttcagatgcatctgtcccccagggtatgaagtaaaaagcgagaactgcattgatataaatgaatgtgatgaagatcccaacatttgtctttttggttcctgtactaatactccagggggcttccagtgcctctgcccccctggctttgtactatctgataatggacggagatgctttgatactcgccagagcttctgcttcacaaattttgaaaatggaaagtgttctgtacccaaagctttcaacaccacaaaagcaaaatgctgctgtagtaagatgccaggagagggctggggggacccctgtgagctgtgccccaaagacgatgaagttgcatttcaggatttgtgtccatatggccatggaactgtccctagtcttcatgatacacgtgaagatgtcaatgagtgtcttgagagcccaggcatttgttcaaatggtcaatgtatcaacaccgacggatcttttcgctgtgaatgtccaatgggctacaaccttgactacactggagtacgctgtgtggatactgatgagtgttcaatcggcaatccgtgtggaaatggtacatgcaccaatgttattgggagttttgaatgcaattgcaatgaaggctttgagccagggcccatgatgaattgtgaagatatcaacgaatgtgcccagaacccactgctgtgtgctttacgctgcatgaacacttttgggtcctatgaatgcacgtgcccgattggctatgccctcagggaagatcaaaagatgtgcaaagatctggatgaatgtgctgaagggttacacgactgtgaatctaggggcatgatgtgtaagaatctaatcggcaccttcatgtgcatctgccctcctggaatggcccgaaggcccgatggagaaggctgtgtagatgaaaatgaatgcaggaccaagccaggaatctgtgaaaatggacgttgtgttaacattattggaagctatagatgtgagtgtaatgaaggattccagtcaagttcttcaggcactgaatgccttgacaatcgacagggtctctgctttgcagaggtactgcagacaatatgtcaaatggcatccagtagtcgcaatctcgtcactaagtcagaatgctgctgtgatggtgggcgaggctggggccaccagtgcgagctttgcccacttcctggaactgcccagtacaaaaagatatgtcctcatggcccaggatatacaactgatggaagagatattgatgaatgtaaggtaatgccaaacctctgcaccaatggtcagtgcatcaataccatgggctcattccgatgcttctgcaaggttggctacaccacagacatcagtggaacctcttgtatagaccttgatgaatgctcccagtccccgaaaccatgcaactacatctgcaagaacactgaggggagttatcagtgttcatgtccgagggggtatgtcctgcaagaggatggaaagacatgcaaagaccttgatgaatgtcaaacaaagcagcataactgccagttcctctgtgtcaacaccctgggggggtttacctgtaaatgtccacctggtttcacacagcatcacactgcttgtatcgacaacaacgaatgtgggtctcaaccttcgctttgtggagcaaagggaatctgtcaaaacactccaggcagtttcagctgtgaatgccaaagagggttctctcttgatgccaccggactgaactgtgaagatgttgatgaatgtgatgggaaccacaggtgccaacacggctgccagaacatcctgggtggctacagatgtggctgcccccaaggctacatccagcactaccagtggaatcagtgtgtcgatgagaatgaatgctccaatcccaatgcctgtggctctgcttcctgctacaacaccctggggagttacaagtgcgcctgcccctcggggttctccttcgaccagttctccagtgcctgccacgacgtgaatgagtgctcgtcctccaagaacccctgcaattacggctgctctaacacggaggggggctacctctgtggctgcccccctgggtattacagagtgggacaaggccactgtgtctcaggaatgggatttaacaaggggcagtacctgtcactggatacagaggtcgatgaggaaaatgctctgtccccagaagcatgctacgagtgcaaaatcaacggctattctaagaaagacagcaggcagaagagaagtattcatgaacctgatcccactgctgttgaacagatcagcctagagagtgtcgacatggacagccccgtcaacatgaagttcaacctctcccacctcggctctaaggagcacatcctggaactaaggcccgccatccagcccctcaacaaccacatccgttatgtcatctctcaagggaacgatgacagcgtcttccgcatccaccaaaggaatgggctcagctacttgcacacggccaagaagaagctcatgcccggcacatacacactggaaatcactagcatccctctctacaagaagaaggagcttaagaaactggaagagagcaatgaggatgactacctcctaggggagcttggggaggctctcagaatgaggctgcagattcagctctattaacccttcacagacttgggcccaggctcaaatcctagcacagccagtctgcagaagcatttgaaaagtcaaggactaattttaaagaggaaaaataataataactcttgtttctttcctccctgtcttagactttgaatgttgaccctcacagggagggataatttagactctggtatggccaaagatttgagcacaaaggcaaccgtggttactgtattttttatataacttcattttaaaatatattaaaagaaacctaaatgttcaagatatcagcatatggcactaaatgcacaaaaataatgtgagctttttttttttttcctgttagcagtctgtaacactttgggtattttgctatagttgctaattaaaaaaatatagatgtttatttatttttaatgcagtaatatatggagaaatgaacaaactatgtaaacaaaaagggaaactcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaagacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtactgtaggcagctgaagaaccgccgttcccttgaaagggaacacctggcattctgtggtgtttcgtgctgtcttaaataatggtgcatttattatgttcaagttatttcaggattgccatatgtgcaaacaaatcatgcaatgcagccaaggaatatatgttgttgttgttgttttaaacccattttttttttagaattttcattaatactgtagttatacaccatatgcctcattttatcatagcctattgtgtatgaaagatgtttgtacaatgaattgatgtttagtttgctttagtcatttaaaaagatattgtaccaggatgtgctattaagagcacgtatccattattcttctcaacccaagaacctgtttcctggaccagtgaccaaacctcatatgtgaaatggccaaagcacatgcaggctcctggttgttcctctcaaacctgtgctgaccaaagattagtaaccagttatacccagtattttgaggttttattgtttttttaataactaaaaaagaaaaaaggaacagtgtaaatttgtaatcaagagtttgtgaggaaaaacttatggtttttggttttgtttgtttttgtaggtctgtgtatcaaatatgacacttttcttgcaataaagcttattttggggtatttttctgactgaaaattttatgagaccacaacgcctgttgtatttgcgggaggggctgggggctttgtctatgggaacctgtattgaagtaataatagagagccagacacacaggaaaataaaggaatgctggcaaatctgtgaag

SEQ ID NO: 454657 - DNA, 8358 bp, Homo sapiens
atggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaactcagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaagatataaatgaatgtgaaagcaacccatgtgtcaatggggcctgcagaaacaaccttggatctttcaattgtgaatgttcgcccggcagcaaactcagctccacaggattgatctgtattgacagcctgaaggggacctgttggctcaacatccaggacagccgctgtgaggtgaatattaatggagccactctgaaatctgaatgctgtgccaccctcggagccgcctgggggagcccctgtgagcggtgtgaactagatacagcttgcccaagagggcttgccaggattaaaggtgttacgtgtgaagatgttaatgagtgtgaggtgttccctggcgtttgtccaaatggacgctgtgtcaacagtaagggatcttttcattgcgagtgccctgaaggccttacgttggatgggactggccgtgtatgtttggatattcgcatggagcagtgttacttgaagtgggatgaagatgaatgcatccaccccgttcctggaaagttccgcatggatgcctgctgctgtgctgtcggggcggcttggggcaccgagtgtgaggagtgccccaaacctggcaccaaggaatacgagacactgtgcccccgcggggctggctttgctaaccgaggggatgttcttactgggcggccattttacaaagacatcaatgaatgcaaagcatttcctgggatgtgcacttatgggaagtgcagaaatacaatcggaagcttcaaatgccgttgcaatagtggctttgctctagacatggaggaaagaaactgcacggacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaagatattgatgaatgctccttccaaaacatttgtgtctctggaacatgtaataacctgcctggaatgtttcattgcatctgcgatgatggttatgaattggacagaacaggagggaactgtacagatattgatgagtgtgcagatcctataaactgtgtcaatggcctatgtgtcaacacgcctggtcgctatgagtgtaactgcccacccgattttcagttgaacccaactggtgtgggttgtgttgacaaccgtgtgggcaactgctacctgaagtttggacctcgaggagatgggagtctgtcttgcaacaccgagatcggggtgggcgtcagtcgctcttcatgctgctgctctctgggaaaggcctggggaaacccctgtgagacatgcccccctgtcaatagcactgaatattacaccctgtgtcccggaggtgaaggcttcagacctaaccccatcacaatcattttagaagacattgacgaatgccaggagttaccaggtctctgccagggtggaaactgcatcaacacttttgggagcttccagtgtgagtgcccacaaggctactacctcagcgaggatacccgcatctgtgaggatattgatgagtgttttgcacatcctggtgtgtgtgggcctgggacctgctataacaccctgggaaattacacctgcatttgcccacctgagtacatgcaggtcaatggaggccacaactgcatggacatgagaaaaagcttttgctaccgaagctataatggaaccacttgtgagaatgagttgcctttcaatgtgacaaaaaggatgtgctgctgcacatataatgtgggcaaagcttggaacaaaccttgtgaaccatgcccaactccaggaacagctgactttaaaaccatatgtggaaatattcctggattcacctttgacattcacacaggaaaagctgttgacattgatgaatgtaaagagattccaggcatttgtgcaaatggtgtgtgcattaaccagattggcagtttccgctgtgaatgccctacaggattcagttacaatgacctgctgttggtttgtgaagatatagatgagtgcagcaatggtgataatctctgccagcggaatgcagactgcatcaatagtcctggtagttaccgctgtgaatgtgccgcgggtttcaaactttcacccaatggggcctgtgtagatcgcaatgaatgtttagaaattcctaacgtttgcagtcatggcttgtgtgttgatctgcaaggaagttaccagtgcatctgccacaatggctttaaggcttctcaggaccagaccatgtgcatggatgttgatgagtgcgagcggcatccatgtggaaatggaacttgtaaaaacaccgttggatcctataactgtctgtgctacccagggtttgaactcactcataataatgattgcctggacatagatgagtgcagttccttttttggtcaggtgtgcagaaatggacgttgttttaatgaaattggttctttcaagtgtctatgtaacgaaggttatgaacttaccccagatggcaaaaactgtatagacactaatgagtgtgtcgcccttcccggctcttgctctcctggtacctgtcagaatttggagggatccttcagatgcatctgtcccccagggtatgaagtaaaaagcgagaactgcattgatataaatgaatgtgatgaagatcccaacatttgtctttttggttcctgtactaatactccagggggcttccagtgcctctgcccccctggctttgtactatctgataatggacggagatgctttgatactcgccagagcttctgcttcacaaattttgaaaatggaaaatgctctgtccccagaagcatgctacgagtgcaaaatcaacggctattctaagaaagacagcaggcagaagagaagtattcatgaacctgatcccactgctgttgaacagatcagcctagagagtgtcgacatggacagccccgtcaacatgaagttcaacctctcccacctcggctctaaggagcacatcctggaactaaggcccgccatccagcccctcaacaaccacatccgttatgtcatctctcaagggaacgatgacagcgtcttccgcatccaccaaaggaatgggctcagctacttgcacacggccaagaagaagctcatgcccggcacatacacactggaaatcactagcatccctctctacaagaagaaggagcttaagaaactggaagagagcaatgaggatgactacctcctaggggagcttggggaggctctcagaatgaggctgcagattcagctctattaacccttcacagacttgggcccaggctcaaatcctagcacagccagtctgcagaagcatttgaaaagtcaaggactaattttaaagaggaaaaataataataactcttgtttctttcctccctgtcttagactttgaatgttgaccctcacagggagggataatttagactctggtatggccaaagatttgagcacaaaggcaaccgtggttactgtattttttatataacttcattttaaaatatattaaaagaaacctaaatgttcaagatatcagcatatggcactaaatgcacaaaaataatgtgagctttttttttttttcctgttagcagtctgtaacactttgggtattttgctatagttgctaattaaaaaaatatagatgtttatttatttttaatgcagtaatatatggagaaatgaacaaactatgtaaacaaaaagggaaactcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaagacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtactgtaggcagctgaagaaccgccgttcccttgaaagggaacacctggcattctgtggtgtttcgtgctgtcttaaataatggtgcatttattatgttcaagttatttcaggattgccatatgtgcaaacaaatcatgcaatgcagccaaggaatatatgttgttgttgttgttttaaacccattttttttttagaattttcattaatactgtagttatacaccatatgcctcattttatcatagcctattgtgtatgaaagatgtttgtacaatgaattgatgtttagtttgctttagtcatttaaaaagatattgtaccaggatgtgctattaagagcacgtatccattattcttctcaacccaagaacctgtttcctggaccagtgaccaaacctcatatgtgaaatggccaaagcacatgcaggctcctggttgttcctctcaaacctgtgctgaccaaagattagtaaccagttatacccagtattttgaggttttattgtttttttaataactaaaaaagaaaaaaggaacagtgtaaatttgtaatcaagagtttgtgaggaaaaacttatggtttttggttttgtttgtttttgtaggtctgtgtatcaaatatgacacttttcttgcaataaagcttattttggggta

SEQ ID NO: 454658 - DNA, 6646 bp, Homo sapiens
gctcggtaccccatgccctcatccagtggcacgccctcatcaagtggaccacagagaccacctgcttggcgcgccgtcgcttttccgagagggtggctgactccggggtgctggggctggggctgccgcccccgccgctgttgctgtactcctcgccccactggatgagggcatgcatgccctcatccagtgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaagatattgatgaatgctccttccaaaacatttgtgtctctggaacatgtaataacctgcctggaatgtttcattgcatctgcgatgatggttatgaattggacagaacaggagggaactgtacagatattgatgagtgtgcagatcctataaactgtgtcaatggcctatgtgtcaacacgcctggtcgctatgagtgtaactgcccacccgattttcagttgaacccaactggtgtgggttgtgttgacaaccgtgtgggcaactgctacctgaagtttggacctcgaggagatgggagtctgtcttgcaacaccgagatcggggtgggcgtcagtcgctcttcatgctgctgctctctgggaaaggcctggggaaacccctgtgagacatgcccccctgtcaatagcactgaatattacaccctgtgtcccggaggtgaaggcttcagacctaaccccatcacaatcattttagaagacattgacgaatgccaggagttaccaggtctctgccagggtggaaactgcatcaacacttttgggagcttccagtgtgagtgcccacaaggctactacctcagcgaggatacccgcatctgtgaggatattgatgagtgttttgcacatcctggtgtgtgtgggcctgggacctgctataacaccctgggaaattacacctgcatttgcccacctgagtacatgcaggtcaatggaggccacaactgcatggacatgagaaaaagcttttgctaccgaagctataatggaaccacttgtgagaatgagttgcctttcaatgtgacaaaaaggatgtgctgctgcacatataatgtgggcaaagcttggaacaaaccttgtgaaccatgcccaactccaggaacagctgactttaaaaccatatgtggaaatattcctggattcacctttgacattcacacaggaaaagctgttgacattgatgaatgtaaagagattccaggcatttgtgcaaatggtgtgtgcattaaccagattggcagtttccgctgtgaatgccctacaggattcagttacaatgacctgctgttggtttgtgaagatatagatgagtgcagcaatggtgataatctctgccagcggaatgcagactgcatcaatagtcctggtagttaccgctgtgaatgtgccgcgggtttcaaactttcacccaatggggcctgtgtagatcgcaatgaatgtttagaaattcctaacgtttgcagtcatggcttgtgtgttgatctgcaaggaagttaccagtgcatctgccacaatggctttaaggcttctcaggaccagaccatgtgcatggatgttgatgagtgcgagcggcatccatgtggaaatggaacttgtaaaaacaccgttggatcctataactgtctgtgctacccagggtttgaactcactcataataatgattgcctggacatagatgagtgcagttccttttttggtcaggtgtgcagaaatggacgttgttttaatgaaattggttctttcaagtgtctatgtaacgaaggttatgaacttaccccagatggcaaaaactgtatagacactaatgagtgtgtcgcccttcccggctcttgctctcctggtacctgtcagaatttggagggatccttcagatgcatctgtcccccagggtatgaagtaaaaagcgagaactgcattgatataaatgaatgtgatgaagatcccaacatttgtctttttggttcctgtactaatactccagggggcttccagtgcctctgcccccctggctttgtactatctgataatggacggagatgctttgatactcgccagagcttctgcttcacaaattttgaaaatggaaagtgttctgtacccaaagctttcaacaccacaaaagcaaaatgctgctgtagtaagatgccaggagagggctggggggacccctgtgagctgtgccccaaagacgatgaagttgcatttcaggatttgtgtccatatggccatggaactgtccctagtcttcatgatacacgtgaagatgtcaatgagtgtcttgagagcccaggcatttgttcaaatggtcaatgtatcaacaccgacggatcttttcgctgtgaatgtccaatgggctacaaccttgactacactggagtacgctgtgtggatactgatgagtgttcaatcggcaatccgtgtggaaatggtacatgcaccaatgttattgggagttttgaatgcaattgcaatgaaggctttgagccagggcccatgatgaattgtgaagatatcaacgaatgtgcccagaacccactgctgtgtgctttacgctgcatgaacacttttgggtcctatgaatgcacgtgcccgattggctatgccctcagggaagatcaaaagatgtgcaaagatctggatgaatgtgctgaagggttacacgactgtgaatctaggggcatgatgtgtaagaatctaatcggcaccttcatgtgcatctgccctcctggaatggcccgaaggcccgatggagaaggctgtgtagatgaaaatgaatgcaggaccaagccaggaatctgtgaaaatggacgttgtgttaacattattggaagctatagatgtgagtgtaatgaaggattccagtcaagttcttcaggcactgaatgccttgacaatcgacagggtctctgctttgcagaggtactgcagacaatatgtcaaatggcatccagtagtcgcaatctcgtcactaagtcagaatgctgctgtgatggtgggcgaggctggggccaccagtgcgagctttgcccacttcctggaactgcccagtacaaaaagatatgtcctcatggcccaggatatacaactgatggaagagatattgatgaatgtaaggtaatgccaaacctctgcaccaatggtcagtgcatcaataccatgggctcattccgatgcttctgcaaggttggctacaccacagacatcagtggaacctcttgtatagaccttgatgaatgctcccagtccccgaaaccatgcaactacatctgcaagaacactgaggggagttatcagtgttcatgtccgagggggtatgtcctgcaagaggatggaaagacatgcaaagaccttgatgaatgtcaaacaaagcagcataactgccagttcctctgtgtcaacaccctgggggggtttacctgtaaatgtccacctggtttcacacagcatcacactgcttgtatcgacaacaacgaatgtgggtctcaaccttcgctttgtggagcaaagggaatctgtcaaaacactccaggcagtttcagctgtgaatgccaaagagggttctctcttgatgccaccggactgaactgtgaagatgttgatgaatgtgatgggaaccacaggtgccaacacggctgccagaacatcctgggtggctacagatgtggctgcccccaaggctacatccagcactaccagtggaatcagtgtgtcgatgagaatgaatgctccaatcccaatgcctgtggctctgcttcctgctacaacaccctggggagttacaagtgcgcctgcccctcggggttctccttcgaccagttctccagtgcctgccacgacgtgaatgagtgctcgtcctccaagaacccctgcaattacggctgctctaacacggaggggggctacctctgtggctgcccccctgggtattacagagtgggacaaggccactgtgtctcaggaatgggatttaacaaggggcagtacctgtcactggatacagaggtcgatgaggaaaatgctctgtccccagaagcatgctacgagtgcaaaatcaacggctattctaagaaagacagcaggcagaagagaagtattcatgaacctgatcccactgctgttgaacagatcagcctagagagtgtcgacatggacagccccgtcaacatgaagttcaacctctcccacctcggctctaaggagcacatcctggaactaaggcccgccatccagcccctcaacaaccacatccgttatgtcatctctcaagggaacgatgacagcgtcttccgcatccaccaaaggaatgggctcagctacttgcacacggccaagaagaagctcatgcccggcacatacacactggaaatcactagcatccctctctacaagaagaaggagcttaagaaactggaagagagcaatgaggatgactacctcctaggggagcttggggaggctctcagaatgaggctgcagattcagctctattaacccttcacagacttgggcccaggctcaaatcctagcacagccagtctgcagaagcatttgaaaagtcaaggactaattttaaagaggaaaaataataataactcttgtttctttcctccctgtcttagactttgaatgttgaccctcacagggagggataatttagactctggtatggccaaagatttgagcacaaaggcaaccgtggttactgtattttttatataacttcattttaaaatatattaaaagaaacctaaatgttcaagatatcagcatatggcactaaatgcacaaaaataatgtgagctttttttttttttcctgttagcagtctgtaacactttgggtattttgctatagttgctaattaaaaaaatatagatgtttatttatttttaatgcagtaatatatggagaaatgaacaaactatgtaaacaaaaagggaaactcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaagacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtactgtaggcagctgaagaaccgccgttcccttgaaagggaacacctggcattctgtggtgtttcgtgctgtcttaaataatggtgcatttattatgttcaagttatttcaggattgccatatgtgcaaacaaatcatgcaatgcagccaaggaatatatgttgttgttgttgttttaaacccattttttttttagaattttcattaatactgtagttatacaccatatgcctcattttatcatagcctattgtgtatgaaagatgtttgtacaatgaattgatgtttagtttgctttagtcatttaaaaagatattgtaccaggatgtgctattaagagcacgtatccattattcttctcaacccaagaacctgtttcctggaccagtgaccaaacctcatatgtgaaatggccaaagcacatgcaggctcctggttgttcctctcaaacctgtgctgaccaaagattagtaaccagttatacccagtattttgaggttttattgtttttttaataactaaaaaagaaaaaaggaacagtgtaaatttgtaatcaagagtttgtgaggaaaaacttatggtttttggttttgtttgtttttgtaggtctgtgtatcaaatatgacacttttcttgcaataaagcttattttggggta

SEQ ID NO: 454659 - DNA, 6892 bp, Homo sapiens
tttttttcaaattgtggacatcaaaaatgcagcctcatcattttcaaatgcctgtttaaggaaacatgtttattcagttttaaagcttcataacttgtagccttagagtttgcatctttcctggcatttctccgcactgtggtgtcaaggaaagagcatggctttcatgtcagacacatctgcaatcagatcctggctcagtcaacatgcattattagctcagtgtggctgtgtcagcttacttggctgctcttagccacaggttcttcctcttctaaacctcaggagattggtgaattcagtgaaaaaatgcatgtcaggccaccagcacagcatatggcaaatgacaccctcactaaacagtgatttttccttccctcttattctgcttgatagaattaaattatctttaaggtctgtgagtaatgtctgtttgtgtaattaagataggagtatttttataagattgtaatgacatgaaagaaactttccccattcccatagtgtctttaatttgctttaaaacacttgaattagtgaaaaagccagttatttattcgaatactataattttctcaaagaatgatcaccattttaagattaattccaatgttctttttcatatctaaataatgttggcatactactgacaagagaaacaagacaaatgtgagagatgtctgcgtttctcctattaataatattacaattggatgttagggtgcaggttaaatagcttttctttaattatattacaattgaatgttagggggcaagataaatagattttctctcaggttgataccctcctttaagtgaatgtgattaactgttgtttcatgttaatgagcattaagtcaagccagtaaaactgatctatttatagagcaaggagaaaatgtgtcatgaaatttggaacttaacagagatgtaatttgcttttttgcacagatgttgatgagtgtgcagaaaacataaacctctgtgagaacggacagtgccttaatgtcccgggtgcatatcgctgcgagtgtgagatgggcttcactccagcctcagacagcagatcctgccaagatattgatgaatgctccttccaaaacatttgtgtctctggaacatgtaataacctgcctggaatgtttcattgcatctgcgatgatggttatgaattggacagaacaggagggaactgtacagatattgatgagtgtgcagatcctataaactgtgtcaatggcctatgtgtcaacacgcctggtcgctatgagtgtaactgcccacccgattttcagttgaacccaactggtgtgggttgtgttgacaaccgtgtgggcaactgctacctgaagtttggacctcgaggagatgggagtctgtcttgcaacaccgagatcggggtgggcgtcagtcgctcttcatgctgctgctctctgggaaaggcctggggaaacccctgtgagacatgcccccctgtcaatagcactgaatattacaccctgtgtcccggaggtgaaggcttcagacctaaccccatcacaatcattttagaagacattgacgaatgccaggagttaccaggtctctgccagggtggaaactgcatcaacacttttgggagcttccagtgtgagtgcccacaaggctactacctcagcgaggatacccgcatctgtgaggatattgatgagtgttttgcacatcctggtgtgtgtgggcctgggacctgctataacaccctgggaaattacacctgcatttgcccacctgagtacatgcaggtcaatggaggccacaactgcatggacatgagaaaaagcttttgctaccgaagctataatggaaccacttgtgagaatgagttgcctttcaatgtgacaaaaaggatgtgctgctgcacatataatgtgggcaaagcttggaacaaaccttgtgaaccatgcccaactccaggaacagctgactttaaaaccatatgtggaaatattcctggattcacctttgacattcacacaggaaaagctgttgacattgatgaatgtaaagagattccaggcatttgtgcaaatggtgtgtgcattaaccagattggcagtttccgctgtgaatgccctacaggattcagttacaatgacctgctgttggtttgtgaagatatagatgagtgcagcaatggtgataatctctgccagcggaatgcagactgcatcaatagtcctggtagttaccgctgtgaatgtgccgcgggtttcaaactttcacccaatggggcctgtgtagatcgcaatgaatgtttagaaattcctaacgtttgcagtcatggcttgtgtgttgatctgcaaggaagttaccagtgcatctgccacaatggctttaaggcttctcaggaccagaccatgtgcatggatgttgatgagtgcgagcggcatccatgtggaaatggaacttgtaaaaacaccgttggatcctataactgtctgtgctacccagggtttgaactcactcataataatgattgcctggacatagatgagtgcagttccttttttggtcaggtgtgcagaaatggacgttgttttaatgaaattggttctttcaagtgtctatgtaacgaaggttatgaacttaccccagatggcaaaaactgtatagacactaatgagtgtgtcgcccttcccggctcttgctctcctggtacctgtcagaatttggagggatccttcagatgcatctgtcccccagggtatgaagtaaaaagcgagaactgcattgatataaatgaatgtgatgaagatcccaacatttgtctttttggttcctgtactaatactccagggggcttccagtgcctctgcccccctggctttgtactatctgataatggacggagatgctttgatactcgccagagcttctgcttcacaaattttgaaaatggaaagtgttctgtacccaaagctttcaacaccacaaaagcaaaatgctgctgtagtaagatgccaggagagggctggggggacccctgtgagctgtgccccaaagacgatgaagttgcatttcaggatttgtgtccatatggccatggaactgtccctagtcttcatgatacacgtgaagatgtcaatgagtgtcttgagagcccaggcatttgttcaaatggtcaatgtatcaacaccgacggatcttttcgctgtgaatgtccaatgggctacaaccttgactacactggagtacgctgtgtggatactgatgagtgttcaatcggcaatccgtgtggaaatggtacatgcaccaatgttattgggagttttgaatgcaattgcaatgaaggctttgagccagggcccatgatgaattgtgaagatatcaacgaatgtgcccagaacccactgctgtgtgctttacgctgcatgaacacttttgggtcctatgaatgcacgtgcccgattggctatgccctcagggaagatcaaaagatgtgcaaagatctggatgaatgtgctgaagggttacacgactgtgaatctaggggcatgatgtgtaagaatctaatcggcaccttcatgtgcatctgccctcctggaatggcccgaaggcccgatggagaaggctgtgtagatgaaaatgaatgcaggaccaagccaggaatctgtgaaaatggacgttgtgttaacattattggaagctatagatgtgagtgtaatgaaggattccagtcaagttcttcaggcactgaatgccttgacaatcgacagggtctctgctttgcagaggtactgcagacaatatgtcaaatggcatccagtagtcgcaatctcgtcactaagtcagaatgctgctgtgatggtgggcgaggctggggccaccagtgcgagctttgcccacttcctggaactgcccagtacaaaaagatatgtcctcatggcccaggatatacaactgatggaagagatattgatgaatgtaaggtaatgccaaacctctgcaccaatggtcagtgcatcaataccatgggctcattccgatgcttctgcaaggttggctacaccacagacatcagtggaacctcttgtatagaccttgatgaatgctcccagtccccgaaaccatgcaactacatctgcaagaacactgaggggagttatcagtgttcatgtccgagggggtatgtcctgcaagaggatggaaagacatgcaaagaccttgatgaatgtcaaacaaagcagcataactgccagttcctctgtgtcaacaccctgggggggtttacctgtaaatgtccacctggtttcacacagcatcacactgcttgtatcgacaacaacgaatgtgggtctcaaccttcgctttgtggagcaaagggaatctgtcaaaacactccaggcagtttcagctgtgaatgccaaagagggttctctcttgatgccaccggactgaactgtgaagatgttgatgaatgtgatgggaaccacaggtgccaacacggctgccagaacatcctgggtggctacagatgtggctgcccccaaggctacatccagcactaccagtggaatcagtgtgtcgatgagaatgaatgctccaatcccaatgcctgtggctctgcttcctgctacaacaccctggggagttacaagtgcgcctgcccctcggggttctccttcgaccagttctccagtgcctgccacgacgtgaatgagtgctcgtcctccaagaacccctgcaattacggctgctctaacacggaggggggctacctctgtggctgcccccctgggtattacagagtgggacaaggccactgtgtctcaggaatgggatttaacaaggggcagtacctgtcactggatacagaggtcgatgaggaaaatgctctgtccccagaagcatgctacgagtgcaaaatcaacggctattctaagaaagacagcaggcagaagagaagtattcatgaacctgatcccactgctgttgaacagatcagcctagagagtgtcgacatggacagccccgtcaacatgaagttcaacctctcccacctcggctctaaggagcacatcctggaactaaggcccgccatccagcccctcaacaaccacatccgttatgtcatctctcaagggaacgatgacagcgtcttccgcatccaccaaaggaatgggctcagctacttgcacacggccaagaagaagctcatgcccggcacatacacactggaaatcactagcatccctctctacaagaagaaggagcttaagaaactggaagagagcaatgaggatgactacctcctaggggagcttggggaggctctcagaatgaggctgcagattcagctctattaacccttcacagacttgggcccaggctcaaatcctagcacagccagtctgcagaagcatttgaaaagtcaaggactaattttaaagaggaaaaataataataactcttgtttctttcctccctgtcttagactttgaatgttgaccctcacagggagggataatttagactctggtatggccaaagatttgagcacaaaggcaaccgtggttactgtattttttatataacttcattttaaaatatattaaaagaaacctaaatgttcaagatatcagcatatggcactaaatgcacaaaaataatgtgagctttttttttttttcctgttagcagtctgtaacactttgggtattttgctatagttgctaattaaaaaaatatagatgtttatttatttttaatgcagtaatatatggagaaatgaacaaactatgtaaacaaaaagggaaactcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaagacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtactgtaggcagctgaagaaccgccgttcccttgaaagggaacacctggcattctgtggtgtttcgtgctgtcttaaataatggtgcatttattatgttcaagttatttcaggattgccatatgtgcaaacaaatcatgcaatgcagccaaggaatatatgttgttgttgttgttttaaacccattttttttttagaattttcattaatactgtagttatacaccatatgcctcattttatcatagcctattgtgtatgaaagatgtttgtacaatgaattgatgtttagtttgctttagtcatttaaaaagatattgtaccaggatgtgctattaagagcacgtatccattattcttctcaacccaagaacctgtttcctggaccagtgaccaaacctcatatgtgaaatggccaaagcacatgcaggctcctggttgttcctctcaaacctgtgctgaccaaagattagtaaccagttatacccagtattttgaggttttattgtttttttaataactaaaaaagaaaaaaggaacagtgtaaatttgtaatcaagagtttgtgaggaaaaacttatggtttttggttttgtttgtttttgtaggtctgtgtatcaaatatgacacttttcttgcaataaagcttattttggggta

SEQ ID NO: 454660 - DNA, 10234 bp, Homo sapiens
atggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaactcagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaagatataaatgaatgtgaaagcaacccatgtgtcaatggggcctgcagaaacaaccttggatctttcaattgtgaatgttcgcccggcagcaaactcagctccacaggattgatctgtattgacagcctgaaggggacctgttggctcaacatccaggacagccgctgtgaggtgaatattaatggagccactctgaaatctgaatgctgtgccaccctcggagccgcctgggggagcccctgtgagcggtgtgaactagatacagcttgcccaagagggcttgccaggattaaaggtgttacgtgtgaagatgttaatgagtgtgaggtgttccctggcgtttgtccaaatggacgctgtgtcaacagtaagggatcttttcattgcgagtgccctgaaggccttacgttggatgggactggccgtgtatgtttggatattcgcatggagcagtgttacttgaagtgggatgaagatgaatgcatccaccccgttcctggaaagttccgcatggatgcctgctgctgtgctgtcggggcggcttggggcaccgagtgtgaggagtgccccaaacctggcaccaaggaatacgagacactgtgcccccgcggggctggctttgctaaccgaggggatgttcttactgggcggccattttacaaagacatcaatgaatgcaaagcatttcctgggatgtgcacttatgggaagtgcagaaatacaatcggaagcttcaaatgccgttgcaatagtggctttgctctagacatggaggaaagaaactgcacggacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaagatattgatgaatgctccttccaaaacatttgtgtctctggaacatgtaataacctgcctggaatgtttcattgcatctgcgatgatggttatgaattggacagaacaggagggaactgtacagatattgatgagtgtgcagatcctataaactgtgtcaatggcctatgtgtcaacacgcctggtcgctatgagtgtaactgcccacccgattttcagttgaacccaactggtgtgggttgtgttgacaaccgtgtgggcaactgctacctgaagtttggacctcgaggagatgggagtctgtcttgcaacaccgagatcggggtgggcgtcagtcgctcttcatgctgctgctctctgggaaaggcctggggaaacccctgtgagacatgcccccctgtcaatagcactgaatattacaccctgtgtcccggaggtgaaggcttcagacctaaccccatcacaatcattttagaagacattgacgaatgccaggagttaccaggtctctgccagggtggaaactgcatcaacacttttgggagcttccagtgtgagtgcccacaaggctactacctcagcgaggatacccgcatctgtgaggatattgatgagtgttttgcacatcctggtgtgtgtgggcctgggacctgctataacaccctgggaaattacacctgcatttgcccacctgagtacatgcaggtcaatggaggccacaactgcatggacatgagaaaaagcttttgctaccgaagctataatggaaccacttgtgagaatgagttgcctttcaatgtgacaaaaaggatgtgctgctgcacatataatgtgggcaaagcttggaacaaaccttgtgaaccatgcccaactccaggaacagctgactttaaaaccatatgtggaaatattcctggattcacctttgacattcacacaggaaaagctgttgacattgatgaatgtaaagagattccaggcatttgtgcaaatggtgtgtgcattaaccagattggcagtttccgctgtgaatgccctacaggattcagttacaatgacctgctgttggtttgtgaagatatagatgagtgcagcaatggtgataatctctgccagcggaatgcagactgcatcaatagtcctggtagttaccgctgtgaatgtgccgcgggtttcaaactttcacccaatggggcctgtgtagatcgcaatgaatgtttagaaattcctaacgtttgcagtcatggcttgtgtgttgatctgcaaggaagttaccagtgcatctgccacaatggctttaaggcttctcaggaccagaccatgtgcatggatgttgatgagtgcgagcggcatccatgtggaaatggaacttgtaaaaacaccgttggatcctataactgtctgtgctacccagggtttgaactcactcataataatgattgcctggacatagatgagtgcagttccttttttggtcaggtgtgcagaaatggacgttgttttaatgaaattggttctttcaagtgtctatgtaacgaaggttatgaacttaccccagatggcaaaaactgtatagacactaatgagtgtgtcgcccttcccggctcttgctctcctggtacctgtcagaatttggagggatccttcagatgcatctgtcccccagggtatgaagtaaaaagcgagaactgcattgatataaatgaatgtgatgaagatcccaacatttgtctttttggttcctgtactaatactccagggggcttccagtgcctctgcccccctggctttgtactatctgataatggacggagatgctttgatactcgccagagcttctgcttcacaaattttgaaaatggaaagtgttctgtacccaaagctttcaacaccacaaaagcaaaatgctgctgtagtaagatgccaggagagggctggggggacccctgtgagctgtgccccaaagacgatgaagttgcatttcaggatttgtgtccatatggccatggaactgtccctagtcttcatgatacacgtgaagatgtcaatgagtgtcttgagagcccaggcatttgttcaaatggtcaatgtatcaacaccgacggatcttttcgctgtgaatgtccaatgggctacaaccttgactacactggagtacgctgtgtggatactgatgagtgttcaatcggcaatccgtgtggaaatggtacatgcaccaatgttattgggagttttgaatgcaattgcaatgaaggctttgagccagggcccatgatgaattgtgaagatatcaacgaatgtgcccagaacccactgctgtgtgctttacgctgcatgaacacttttgggtcctatgaatgcacgtgcccgattggctatgccctcagggaagatcaaaagatgtgcaaagatctggatgaatgtgctgaagggttacacgactgtgaatctaggggcatgatgtgtaagaatctaatcggcaccttcatgtgcatctgccctcctggaatggcccgaaggcccgatggagaaggctgtgtagatgaaaatgaatgcaggaccaagccaggaatctgtgaaaatggacgttgtgttaacattattggaagctatagatgtgagtgtaatgaaggattccagtcaagttcttcaggcactgaatgccttgacaatcgacagggtctctgctttgcagaggtactgcagacaatatgtcaaatggcatccagtagtcgcaatctcgtcactaagtcagaatgctgctgtgatggtgggcgaggctggggccaccagtgcgagctttgcccacttcctggaactgcccagtacaaaaagatatgtcctcatggcccaggatatacaactgatggaagagatattgatgaatgtaaggtaatgccaaacctctgcaccaatggtcagtgcatcaataccatgggctcattccgatgcttctgcaaggttggctacaccacagacatcagtggaacctcttgtatagaccttgatgaatgctcccagtccccgaaaccatgcaactacatctgcaagaacactgaggggagttatcagtgttcatgtccgagggggtatgtcctgcaagaggatggaaagacatgcaaagaccttgatgaatgtcaaacaaagcagcataactgccagttcctctgtgtcaacaccctgggggggtttacctgtaaatgtccacctggtttcacacagcatcacactgcttgtatcgacaacaacgaatgtgggtctcaaccttcgctttgtggagcaaagggaatctgtcaaaacactccaggcagtttcagctgtgaatgccaaagagggttctctcttgatgccaccggactgaactgtgaagatgttgatgaatgtgatgggaaccacaggtgccaacacggctgccagaacatcctgggtggctacagatgtggctgcccccaaggctacatccagcactaccagtggaatcagtgtgtcgatgagaatgaatgctccaatcccaatgcctgtggctctgcttcctgctacaacaccctggggagttacaagtgcgcctgcccctcggggttctccttcgaccagttctccagtgcctgccacgacgtgaatgagtgctcgtcctccaagaacccctgcaattacggctgctctaacacggaggggggctacctctgtggctgcccccctgggtattacagagtgggacaaggccactgtgtctcaggaatgggatttaacaaggggcagtacctgtcactggatacagaggtcgatgaggaaaatgctctgtccccagaagcatgctacgagtgcaaaatcaacggctattctaagaaagacagcaggcagaagagaagtattcatgaacctgatcccactgctgttgaacagatcagcctagagagtgtcgacatggacagccccgtcaacatgaagttcaacctctcccacctcggctctaaggagcacatcctggaactaaggcccgccatccagcccctcaacaaccacatccgttatgtcatctctcaagggaacgatgacagcgtcttccgcatccaccaaaggaatgggctcagctacttgcacacggccaagaagaagctcatgcccggcacatacacactggaaatcactagcatccctctctacaagaagaaggagcttaagaaactggaagagagcaatgaggatgactacctcctaggggagcttggggaggctctcagaatgaggctgcagattcagctctattaacccttcacagacttgggcccaggctcaaatcctagcacagccagtctgcagaagcatttgaaaagtcaaggactaattttaaagaggaaaaataataataactcttgtttctttcctccctgtcttagactttgaatgttgaccctcacagggagggataatttagactctggtatggccaaagatttgagcacaaaggcaaccgtggttactgtattttttatataacttcattttaaaatatattaaaagaaacctaaatgttcaagatatcagcatatggcactaaatgcacaaaaataatgtgagctttttttttttttcctgttagcagtctgtaacactttgggtattttgctatagttgctaattaaaaaaatatagatgtttatttatttttaatgcagtaatatatggagaaatgaacaaactatgtaaacaaaaagggaaactcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaagacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccagctgaagaaccgccgttcccttgaaagggaacacctggcattctgtggtgtttcgtgctgtcttaaataatggtgcatttattatgttcaagttatttcaggattgccatatgtgcaaacaaatcatgcaatgcagccaaggaatatatgttgttgttgttgttttaaacccattttttttttagaattttcattaatactgtagttatacaccatatgcctcattttatcatagcctattgtgtatgaaagatgtttgtacaatgaattgatgtttagtttgctttagtcatttaaaaagatattgtaccaggatgtgctattaagagcacgtatccattattcttctcaacccaagaacctgtttcctggaccagtgaccaaacctcatatgtgaaatggccaaagcacatgcaggctcctggttgttcctctcaaacctgtgctgaccaaagattagtaaccagttatacccagtattttgaggttttattgtttttttaataactaaaaaagaaaaaaggaacagtgtaaatttgtaatcaagagtttgtgaggaaaaacttatggtttttggttttgtttgtttttgtaggtctgtgtatcaaatatgacacttttcttgcaataaagcttattttggggta

SEQ ID NO: 454661 - DNA, 10366 bp, Homo sapiens
atggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaactcagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaagatataaatgaatgtgaaagcaacccatgtgtcaatggggcctgcagaaacaaccttggatctttcaattgtgaatgttcgcccggcagcaaactcagctccacaggattgatctgtattgacagcctgaaggggacctgttggctcaacatccaggacagccgctgtgaggtgaatattaatggagccactctgaaatctgaatgctgtgccaccctcggagccgcctgggggagcccctgtgagcggtgtgaactagatacagcttgcccaagagggcttgccaggattaaaggtgttacgtgtgaagatgttaatgagtgtgaggtgttccctggcgtttgtccaaatggacgctgtgtcaacagtaagggatcttttcattgcgagtgccctgaaggccttacgttggatgggactggccgtgtatgtttggatattcgcatggagcagtgttacttgaagtgggatgaagatgaatgcatccaccccgttcctggaaagttccgcatggatgcctgctgctgtgctgtcggggcggcttggggcaccgagtgtgaggagtgccccaaacctggcaccaaggaatacgagacactgtgcccccgcggggctggctttgctaaccgaggggatgttcttactgggcggccattttacaaagacatcaatgaatgcaaagcatttcctgggatgtgcacttatgggaagtgcagaaatacaatcggaagcttcaaatgccgttgcaatagtggctttgctctagacatggaggaaagaaactgcacggacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaagatattgatgaatgctccttccaaaacatttgtgtctctggaacatgtaataacctgcctggaatgtttcattgcatctgcgatgatggttatgaattggacagaacaggagggaactgtacagatattgatgagtgtgcagatcctataaactgtgtcaatggcctatgtgtcaacacgcctggtcgctatgagtgtaactgcccacccgattttcagttgaacccaactggtgtgggttgtgttgacaaccgtgtgggcaactgctacctgaagtttggacctcgaggagatgggagtctgtcttgcaacaccgagatcggggtgggcgtcagtcgctcttcatgctgctgctctctgggaaaggcctggggaaacccctgtgagacatgcccccctgtcaatagcactgaatattacaccctgtgtcccggaggtgaaggcttcagacctaaccccatcacaatcattttagaagacattgacgaatgccaggagttaccaggtctctgccagggtggaaactgcatcaacacttttgggagcttccagtgtgagtgcccacaaggctactacctcagcgaggatacccgcatctgtgaggatattgatgagtgttttgcacatcctggtgtgtgtgggcctgggacctgctataacaccctgggaaattacacctgcatttgcccacctgagtacatgcaggtcaatggaggccacaactgcatggacatgagaaaaagcttttgctaccgaagctataatggaaccacttgtgagaatgagttgcctttcaatgtgacaaaaaggatgtgctgctgcacatataatgtgggcaaagcttggaacaaaccttgtgaaccatgcccaactccaggaacagctgactttaaaaccatatgtggaaatattcctggattcacctttgacattcacacaggaaaagctgttgacattgatgaatgtaaagagattccaggcatttgtgcaaatggtgtgtgcattaaccagattggcagtttccgctgtgaatgccctacaggattcagttacaatgacctgctgttggtttgtgaagatatagatgagtgcagcaatggtgataatctctgccagcggaatgcagactgcatcaatagtcctggtagttaccgctgtgaatgtgccgcgggtttcaaactttcacccaatggggcctgtgtagatcgcaatgaatgtttagaaattcctaacgtttgcagtcatggcttgtgtgttgatctgcaaggaagttaccagtgcatctgccacaatggctttaaggcttctcaggaccagaccatgtgcatggatgttgatgagtgcgagcggcatccatgtggaaatggaacttgtaaaaacaccgttggatcctataactgtctgtgctacccagggtttgaactcactcataataatgattgcctggacatagatgagtgcagttccttttttggtcaggtgtgcagaaatggacgttgttttaatgaaattggttctttcaagtgtctatgtaacgaaggttatgaacttaccccagatggcaaaaactgtatagacactaatgagtgtgtcgcccttcccggctcttgctctcctggtacctgtcagaatttggagggatccttcagatgcatctgtcccccagggtatgaagtaaaaagcgagaactgcattgatataaatgaatgtgatgaagatcccaacatttgtctttttggttcctgtactaatactccagggggcttccagtgcctctgcccccctggctttgtactatctgataatggacggagatgctttgatactcgccagagcttctgcttcacaaattttgaaaatggaaagtgttctgtacccaaagctttcaacaccacaaaagcaaaatgctgctgtagtaagatgccaggagagggctggggggacccctgtgagctgtgccccaaagacgatgaagttgcatttcaggatttgtgtccatatggccatggaactgtccctagtcttcatgatacacgtgaagatgtcaatgagtgtcttgagagcccaggcatttgttcaaatggtcaatgtatcaacaccgacggatcttttcgctgtgaatgtccaatgggctacaaccttgactacactggagtacgctgtgtggatactgatgagtgttcaatcggcaatccgtgtggaaatggtacatgcaccaatgttattgggagttttgaatgcaattgcaatgaaggctttgagccagggcccatgatgaattgtgaagatatcaacgaatgtgcccagaacccactgctgtgtgctttacgctgcatgaacacttttgggtcctatgaatgcacgtgcccgattggctatgccctcagggaagatcaaaagatgtgcaaagatctggatgaatgtgctgaagggttacacgactgtgaatctaggggcatgatgtgtaagaatctaatcggcaccttcatgtgcatctgccctcctggaatggcccgaaggcccgatggagaaggctgtgtagatgaaaatgaatgcaggaccaagccaggaatctgtgaaaatggacgttgtgttaacattattggaagctatagatgtgagtgtaatgaaggattccagtcaagttcttcaggcactgaatgccttgacaatcgacagggtctctgctttgcagaggtactgcagacaatatgtcaaatggcatccagtagtcgcaatctcgtcactaagtcagaatgctgctgtgatggtgggcgaggctggggccaccagtgcgagctttgcccacttcctggaactgcccagtacaaaaagatatgtcctcatggcccaggatatacaactgatggaagagatattgatgaatgtaaggtaatgccaaacctctgcaccaatggtcagtgcatcaataccatgggctcattccgatgcttctgcaaggttggctacaccacagacatcagtggaacctcttgtatagaccttgatgaatgctcccagtccccgaaaccatgcaactacatctgcaagaacactgaggggagttatcagtgttcatgtccgagggggtatgtcctgcaagaggatggaaagacatgcaaagaccttgatgaatgtcaaacaaagcagcataactgccagttcctctgtgtcaacaccctgggggggtttacctgtaaatgtccacctggtttcacacagcatcacactgcttgtatcgacaacaacgaatgtgggtctcaaccttcgctttgtggagcaaagggaatctgtcaaaacactccaggcagtttcagctgtgaatgccaaagagggttctctcttgatgccaccggactgaactgtgaagatgttgatgaatgtgatgggaaccacaggtgccaacacggctgccagaacatcctgggtggctacagatgtggctgcccccaaggctacatccagcactaccagtggaatcagtgtgtcgatgagaatgaatgctccaatcccaatgcctgtggctctgcttcctgctacaacaccctggggagttacaagtgcgcctgcccctcggggttctccttcgaccagttctccagtgcctgccacgacgtgaatgagtgctcgtcctccaagaacccctgcaattacggctgctctaacacggaggggggctacctctgtggctgcccccctgggtattacagagtgggacaaggccactgtgtctcaggaatgggatttaacaaggggcagtacctgtcactggatacagaggtcgatgaggaaaatgctctgtccccagaagcatgctacgagtgcaaaatcaacggctattctaagaaagacagcaggcagaagagaagtattcatgaacctgatcccactgctgttgaacagatcagcctagagagtgtcgacatggacagccccgtcaacatgaagttcaacctctcccacctcggctctaaggagcacatcctggaactaaggcccgccatccagcccctcaacaaccacatccgttatgtcatctctcaagggaacgatgacagcgtcttccgcatccaccaaaggaatgggctcagctacttgcacacggccaagaagaagctcatgcccggcacatacacactggaaatcactagcatccctctctacaagaagaaggagcttaagaaactggaagagagcaatgaggatgactacctcctaggggagcttggggaggctctcagaatgaggctgcagattcagctctattaacccttcacagacttgggcccaggctcaaatcctagcacagccagtctgcagaagcatttgaaaagtcaaggactaattttaaagaggaaaaataataataactcttgtttctttcctccctgtcttagactttgaatgttgaccctcacagggagggataatttagactctggtatggccaaagatttgagcacaaaggcaaccgtggttactgtattttttatataacttcattttaaaatatattaaaagaaacctaaatgttcaagatatcagcatatggcactaaatgcacaaaaataatgtgagctttttttttttttcctgttagcagtctgtaacactttgggtattttgctatagttgctaattaaaaaaatatagatgtttatttatttttaatgcagtaatatatggagaaatgaacaaactatgtaaacaaaaagggaaactcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaagacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtactgtaggcagctgaagaaccgccgttcccttgaaagggaacacctggcattctgtggtgtttcgtgctgtcttaaataatggtgcatttattatgttcaagttatttcaggattgccatatgtgcaaacaaatcatgcaatgcagccaaggaatatatgttgttgttgttgttttaaacccattttttttttagaattttcattaatactgtagttatacaccatatgcctcattttatcatagcctattgtgtatgaaagatgtttgtacaatgaattgatgtttagtttgctttagtcatttaaaaagatattgtaccaggatgtgctattaagagcacgtatccattattcttctcaacccaagaacctgtttcctggaccagtgaccaaacagattagtaaccagttatacccagtattttgaggttttattgtttttttaataactaaaaaagaaaaaaggaacagtgtaaatttgtaatcaagagtttgtgaggaaaaacttatggtttttggttttgtttgtttttgtaggtctgtgtatcaaatatgacacttttcttgcaataaagcttattttggggtatttttctgactgaaaattttatgagaccacaacgcctgttgtatttgcgggaggggctgggggctttgtctatgggaacctgtattgaagtaataatagagagccagacacacaggaaaataaaggaatgctggcaaatctgtgaag

SEQ ID NO: 454662 - DNA, 5510 bp, Homo sapiens
  misc_feature (5280)..(5280): n is a, c, g, or t
atggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaactcagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaagatataaatgaatgtgaaagcaacccatgtgtcaatggggcctgcagaaacaaccttggatctttcaattgtgaatgttcgcccggcagcaaactcagctccacaggattgatctgtattgacagcctgaaggggacctgttggctcaacatccaggacagccgctgtgaggtgaatattaatggagccactctgaaatctgaatgctgtgccaccctcggagccgcctgggggagcccctgtgagcggtgtgaactagatacagcttgcccaagagggcttgccaggattaaaggtgttacgtgtgaagatgttaatgagtgtgaggtgttccctggcgtttgtccaaatggacgctgtgtcaacagtaagggatcttttcattgcgagtgccctgaaggccttacgttggatgggactggccgtgtatgtttggatattcgcatggagcagtgttacttgaagtgggatgaagatgaatgcatccaccccgttcctggaaagttccgcatggatgcctgctgctgtgctgtcggggcggcttggggcaccgagtgtgaggagtgccccaaacctggcaccaaggaatacgagacactgtgcccccgcggggctggctttgctaaccgaggggatgttcttactgggcggccattttacaaagacatcaatgaatgcaaagcatttcctgggatgtgcacttatgggaagtgcagaaatacaatcggaagcttcaaatgccgttgcaatagtggctttgctctagacatggaggaaagaaactgcacggacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaaggtgggtcaccaggattccaactcattttcaagttggatcaaccacagtaaatgaaaccacaacaagggctggaacaagctccacctggaagcagaatacatagcacatgctgcactataaaagtcattcgtttaagcgtggattattttgccgaatgaataatgatgatggcggctttcatctcttatgaagttttcctggccaagagccagtagttggaagtttggatcattcttttttcttttttaaccatttcttctcttctttctcttttttatcactaaatgaatgacatgtggagaaactattcagcttttaaagtatgctccattacttgtctcaactaccactatttattgtgtttatcaaaatcataaaaagctcatttttggcatttaccttcgtggttgagactgctgtctgtatgtctgggaatggaagtcctcttcagggattcagcaagggctgtacttttgcttaatactagtggttccttattctaagtgatgacatcatccacctttcctagaaatgggtctttgtgcctagtatgatatctttccaagaaaaagaatttggattttctattaaattagaaactcaattcacattatatatagtttgagccatcattgtgttatgaatagggactatatgaaaatataaatgaagaaaggagagattgaaaataatttatacaccatagggcttcagtagaatttatgattcacagaaaacctttaaaaaaactcagtttgggccaggcgtggtggctcacgcctatattcccagctctttgggaggccgangcaggtggatcacctgaggttgggagttcaagaccagcctgaacaacatggagaaactccatctctactaaaaatacaaaattagctgggtatggtggctcatgcctgtaatcccagctactcaggaggcagaggcaggaaaattgcttgaaccctggaggcggaggttgcggtgagccaagattgcgccattgcactacagactggacaacaagagcgaaactcagtct

SEQ ID NO: 454663 - DNA, 5234 bp, Homo sapiens
atggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaactcagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaagatataaatgaatgtgaaagcaacccatgtgtcaatggggcctgcagaaacaaccttggatctttcaattgtgaatgttcgcccggcagcaaactcagctccacaggattgatctgtattgacagcctgaaggggacctgttggctcaacatccaggacagccgctgtgaggtgaatattaatggagccactctgaaatctgaatgctgtgccaccctcggagccgcctgggggagcccctgtgagcggtgtgaactagatacagcttgcccaagagggcttgccaggattaaaggtgttacgtgtgaagatgttaatgagtgtgaggtgttccctggcgtttgtccaaatggacgctgtgtcaacagtaagggatcttttcattgcgagtgccctgaaggccttacgttggatgggactggccgtgtatgtttggatattcgcatggagcagtgttacttgaagtgggatgaagatgaatgcatccaccccgttcctggaaagttccgcatggatgcctgctgctgtgctgtcggggcggcttggggcaccgagtgtgaggagtgccccaaacctggcaccaaggaatacgagacactgtgcccccgcggggctggctttgctaaccgaggggatgttcttactgggcggccattttacaaagacatcaatgaatgcaaagcatttcctgggatgtgcacttatgggaagtgcagaaatacaatcggaagcttcaaatgccgttgcaatagtggctttgctctagacatggaggaaagaaactgcacggacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaaggtgggtcaccaggattccaactcattttcaagttggatcaaccacagtaaatgaaaccacaacaagggctggaacaagctccacctggaagcagaatacatagcacatgctgcactataaaagtcattcgtttaagcgtggattattttgccgaatgaataatgatgatggcggctttcatctcttatgaagttttcctggccaagagccagtagttggaagtttggatcattcttttttcttttttaaccatttcttctcttctttctcttttttatcactaaatgaatgacatgtggagaaactattcagcttttaaagtatgctccattacttgtctcaactaccactatttattgtgtttatcaaaatcataaaaagctcattttgggaaaaaaaaaaaaaaaaaaaaaaaaaaaaatttgtgtggggcgcggccccttgggcacgctcagagaagaggttttttagaacccattcgtgtcgtggggcgcgcggcgcggcccagttgggtattagtgtgaccgcgtgggtcaaagcggggggttccagagaggaaaccgcgggcgccaaaagagacaagagcggggcgggggggtcttctccccccccaatttataaaacaacaaggcgcgccccggggggggggggaaaaaccccaccacagaagaccacaagtgatctctttctgtcaggagaaccaacaaatctcccccaagagtggggaggctccaagagggggcaacacagggggggcccacat

SEQ ID NO: 454664 - DNA, 1246 bp, Homo sapiens
atggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatttgttcaggatccccccgacctgctgccgtgaactcgattctctttctcctatttgttaagaagttatgtactttatttctgttgcttcagtggctatcctagctgttttaagatgcatatttaaaattacctgtatgtttgcctatatataaataataaaagaat

SEQ ID NO: 454665 - DNA, 204 bp, Homo sapiens
atgtaaaatatgtaactttaaatgtatttgaaagggcactaagaaaaatttggatacaccccttaggatgagtatattgagcctgtcatttgctgaatgcttgctcattgtctcagccacttggacacaggtatcaaacctcttatttttctattgttttgtagctgaatattacaccctgtgtcccggaggtgaaggcttcag

SEQ ID NO: 454666 - DNA, 581 bp, Homo sapiens
attatagggttagtagtacagaaattgagggttgagtagttacattctaaatgagcatgagagccagcgaatatgattctgattaaaaaaaaaacaaaaaaccttttaccaaacacttgcttaacagtgtgatttacatgaagtatgtaagtttttgtctgaatatacttaaatatatttacttaaatttaagatgtgaactttaacctgtgtaatttatacaagttgcagtttaattaacataatgtactataatttaacataagatcctttattggcagcatcactgcactactatattgtgcttggagactggctatataatgagcttcttgctatttttgtatgcagctgtctgtgaaaatggatgtcagaatggtggacgttgcatcggacccaaccgctgtgcttgtgtttatgggttcactggtccacagtgtgaaagaggtaagaagagaaatgagactttactttctgaagaagtctattttattgtaaaaatgtataattttttgctattcaatgaagattctgctaatgaaattatatttttactcttctttgattatgtctctaagttg

SEQ ID NO: 454667 - DNA, 362 bp, Homo sapiens
gcatatttgggatattttctttatttctaagttttgcataaatggggatttagagaatcacctatgctttgttcagtcatctaagtaatataaattcattgaaaaaatagatttattaattaatagatattcttgcctactctagatattgatgagtgttttgcacatcctggtgtgtgtgggcctgggacctgctataacaccctgggaaattacacctgcatttgcccacctgagtacatgcaggtcaatggaggccacaactgcatgggtaggtaaagaactctgagattaattagagcacagttgttgacttcacacataaagcacttacgtctcagaattattgtttggaagtttgg

SEQ ID NO: 454668 - DNA, 10286 bp, Homo sapiens
atggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaactcagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaagatataaatgaatgtgaaagcaacccatgtgtcaatggggcctgcagaaacaaccttggatctttcaattgtgaatgttcgcccggcagcaaactcagctccacaggattgatctgtattgacagcctgaaggggacctgttggctcaacatccaggacagccgctgtgaggtgaatattaatggagccactctgaaatctgaatgctgtgccaccctcggagccgcctgggggagcccctgtgagcggtgtgaactagatacagcttgcccaagagggcttgccaggattaaaggtgttacgtgtgaagatgttaatgagtgtgaggtgttccctggcgtttgtccaaatggacgctgtgtcaacagtaagggatcttttcattgcgagtgccctgaaggccttacgttggatgggactggccgtgtatgtttggatattcgcatggagcagtgttacttgaagtgggatgaagatgaatgcatccaccccgttcctggaaagttccgcatggatgcctgctgctgtgctgtcggggcggcttggggcaccgagtgtgaggagtgccccaaacctggcaccaaggaatacgagacactgtgcccccgcggggctggctttgctaaccgaggggatgttcttactgggcggccattttacaaagacatcaatgaatgcaaagcatttcctgggatgtgcacttatgggaagtgcagaaatacaatcggaagcttcaaatgccgttgcaatagtggctttgctctagacatggaggaaagaaactgcacggacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaagatattgatgaatgctccttccaaaacatttgtgtctctggaacatgtaataacctgcctggaatgtttcattgcatctgcgatgatggttatgaattggacagaacaggagggaactgtacagatattgatgagtgtgcagatcctataaactgtgtcaatggcctatgtgtcaacacgcctggtcgctatgagtgtaactgcccacccgattttcagttgaacccaactggtgtgggttgtgttgacaaccgtgtgggcaactgctacctgaagtttggacctcgaggagatgggagtctgtcttgcaacaccgagatcggggtgggcgtcagtcgctcttcatgctgctgctctctgggaaaggcctggggaaacccctgtgagacatgcccccctgtcaatagcactgaatattacaccctgtgtcccggaggtgaaggcttcagacctaaccccatcacaatcattttagaagacattgacgaatgccaggagttaccaggtctctgccagggtggaaactgcatcaacacttttgggagcttccagtgtgagtgcccacaaggctactacctcagcgaggatacccgcatctgtgaggatattgatgagtgttttgcacatcctggtgtgtgtgggcctgggacctgctataacaccctgggaaattacacctgcatttgcccacctgagtacatgcaggtcaatggaggccacaactgcatggacatgagaaaaagcttttgctaccgaagctataatggaaccacttgtgagaatgagttgcctttcaatgtgacaaaaaggatgtgctgctgcacatataatgtgggcaaagcttggaacaaaccttgtgaaccatgcccaactccaggaacagctgactttaaaaccatatgtggaaatattcctggattcacctttgacattcacacaggaaaagctgttgacattgatgaatgtaaagagattccaggcatttgtgcaaatggtgtgtgcattaaccagattggcagtttccgctgtgaatgccctacaggattcagttacaatgacctgctgttggtttgtgaagatatagatgagtgcagcaatggtgataatctctgccagcggaatgcagactgcatcaatagtcctggtagttaccgctgtgaatgtgccgcgggtttcaaactttcacccaatggggcctgtgtagatcgcaatgaatgtttagaaattcctaacgtttgcagtcatggcttgtgtgttgatctgcaaggaagttaccagtgcatctgccacaatggctttaaggcttctcaggaccagaccatgtgcatggatgttgatgagtgcgagcggcatccatgtggaaatggaacttgtaaaaacaccgttggatcctataactgtctgtgctacccagggtttgaactcactcataataatgattgcctggacatagatgagtgcagttccttttttggtcaggtgtgcagaaatggacgttgttttaatgaaattggttctttcaagtgtctatgtaacgaaggttatgaacttaccccagatggcaaaaactgtatagacactaatgagtgtgtcgcccttcccggctcttgctctcctggtacctgtcagaatttggagggatccttcagatgcatctgtcccccagggtatgaagtaaaaagcgagaactgcattgatataaatgaatgtgatgaagatcccaacatttgtctttttggttcctgtactaatactccagggggcttccagtgcctctgcccccctggctttgtactatctgataatggacggagatgctttgatactcgccagagcttctgcttcacaaattttgaaaatggaaagtgttctgtacccaaagctttcaacaccacaaaagcaaaatgctgctgtagtaagatgccaggagagggctggggggacccctgtgagctgtgccccaaagacgatgaagttgcatttcaggatttgtgtccatatggccatggaactgtccctagtcttcatgatacacgtgaagatgtcaatgagtgtcttgagagcccaggcatttgttcaaatggtcaatgtatcaacaccgacggatcttttcgctgtgaatgtccaatgggctacaaccttgactacactggagtacgctgtgtggatactgatgagtgttcaatcggcaatccgtgtggaaatggtacatgcaccaatgttattgggagttttgaatgcaattgcaatgaaggctttgagccagggcccatgatgaattgtgaagatatcaacgaatgtgcccagaacccactgctgtgtgctttacgctgcatgaacacttttgggtcctatgaatgcacgtgcccgattggctatgccctcagggaagatcaaaagatgtgcaaagatctggatgaatgtgctgaagggttacacgactgtgaatctaggggcatgatgtgtaagaatctaatcggcaccttcatgtgcatctgccctcctggaatggcccgaaggcccgatggagaaggctgtgtagatgaaaatgaatgcaggaccaagccaggaatctgtgaaaatggacgttgtgttaacattattggaagctatagatgtgagtgtaatgaaggattccagtcaagttcttcaggcactgaatgccttgacaatcgacagggtctctgctttgcagaggtactgcagacaatatgtcaaatggcatccagtagtcgcaatctcgtcactaagtcagaatgctgctgtgatggtgggcgaggctggggccaccagtgcgagctttgcccacttcctggaactgcccagtacaaaaagatatgtcctcatggcccaggatatacaactgatggaagagatattgatgaatgtaaggtaatgccaaacctctgcaccaatggtcagtgcatcaataccatgggctcattccgatgcttctgcaaggttggctacaccacagacatcagtggaacctcttgtatagaccttgatgaatgctcccagtccccgaaaccatgcaactacatctgcaagaacactgaggggagttatcagtgttcatgtccgagggggtatgtcctgcaagaggatggaaagacatgcaaagaccttgatgaatgtcaaacaaagcagcataactgccagttcctctgtgtcaacaccctgggggggtttacctgtaaatgtccacctggtttcacacagcatcacactgcttgtatcgacaacaacgaatgtgggtctcaaccttcgctttgtggagcaaagggaatctgtcaaaacactccaggcagtttcagctgtgaatgccaaagagggttctctcttgatgccaccggactgaactgtgaagatgttgatgaatgtgatgggaaccacaggtgccaacacggctgccagaacatcctgggtggctacagatgtggctgcccccaaggctacatccagcactaccagtggaatcagtgtgtcgatgagaatgaatgctccaatcccaatgcctgtggctctgcttcctgctacaacaccctggggagttacaagtgcgcctgcccctcggggttctccttcgaccagttctccagtgcctgccacgacgtgaatgagtgctcgtcctccaagaacccctgcaattacggctgctctaacacggaggggggctacctctgtggctgcccccctgggtattacagagtgggacaaggccactgtgtctcaggaatgggatttaacaaggggcagtacctgtcactggatacagaggtcgatgaggaaaatgctctgtccccagaagcatgctacgagtgcaaaatcaacggctattctaagaaagacagcaggcagaagagaagtattcatgaacctgatcccactgctgttgaacagatcagcctagagagtgtcgacatggacagccccgtcaacatgaagttcaacctctcccacctcggctctaaggagcacatcctggaactaaggcccgccatccagcccctcaacaaccacatccgttatgtcatctctcaagggaacgatgacagcgtcttccgcatccaccaaaggaatgggctcagctacttgcacacggccaagaagaagctcatgcccggcacatacacactggaaatcactagcatccctctctacaagaagaaggagcttaagaaactggaagagagcaatgaggatgactacctcctaggggagcttggggaggctctcagaatgaggctgcagattcagctctattaacccttcacagacttgggcccaggctcaaatcctagcacagccagtctgcagaagcatttgaaaagtcaaggactaattttaaagaggaaaaataataataactcttgtttctttcctccctgtcttagactttgaatgttgaccctcacagggagggataatttagactctggtatggccaaagatttgagcacaaaggcaaccgtggttactgtattttttatataacttcattttaaaatatattaaaagaaacctaaatgttcaagatatcagcatatggcactaaatgcacaaaaataatgtgagctttttttttttttcctgttagcagtctgtaacactttgggtattttgctatagttgctaattaaaaaaatatagatgtttatttatttttaatgcagtaatatatggagaaatgaacaaactatgtaaacaaaaagggaaactcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaagacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtactgtaggcagctgaagaaccgccgttcccttgaaagggaacacctggcattctgtggtgtttcgtgctgtcttaaataatggtgcatttattatgttcaagttatttcaggattgccatatgtgcaaacaaatcatgcaatgcagccaaggaatatatgttgttgttgttgttttaaacccattttttttttagaattttcattaatactgtagttatacaccatatgcctcattttatcatagcctattgtgtatgaaagatgtttgtacaatgaattgatgtttagtttgctttagtcatttaaaaagatattgtaccaggatgtgctattaagagcacgtatccattattcttctcaacccaagaacctgtttcctggaccagtgaccaaacctcatatgtgaaatggccaaagcacatgcaggctcctggttgttcctctcaaacctgtgctgaccaaagattagtaaccagttatacccagtattttgaggttttattgtttttttaataactaaaaaagaaaaaaggaacagtgtaaatttgtaatcaagagtttgtgaggaaaaacttatggtttttggttttgtttgtttttgtaggtctgtgtatcaaatatgacacttttcttgcaataaagcttattttggggta

SEQ ID NO: 454669 - DNA, 8245 bp, Homo sapiens
atggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaactcagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaagatataaatgaatgtgaaagcaacccatgtgtcaatggggcctgcagaaacaaccttggatctttcaattgtgaatgttcgcccggcagcaaactcagctccacaggattgatctgtattgacagcctgaaggggacctgttggctcaacatccaggacagccgctgtgaggtgaatattaatggagccactctgaaatctgaatgctgtgccaccctcggagccgcctgggggagcccctgtgagcggtgtgaactagatacagcttgcccaagagggcttgccaggattaaaggtgttacgtgtgaagatgttaatgagtgtgaggtgttccctggcgtttgtccaaatggacgctgtgtcaacagtaagggatcttttcattgcgagtgccctgaaggccttacgttggatgggactggccgtgtatgtttggatattcgcatggagcagtgttacttgaagtgggatgaagatgaatgcatccaccccgttcctggaaagttccgcatggatgcctgctgctgtgctgtcggggcggcttggggcaccgagtgtgaggagtgccccaaacctggcaccaaggaatacgagacactgtgcccccgcggggctggctttgctaaccgaggggatgttcttactgggcggccattttacaaagacatcaatgaatgcaaagcatttcctgggatgtgcacttatgggaagtgcagaaatacaatcggaagcttcaaatgccgttgcaatagtggctttgctctagacatggaggaaagaaactgcacggacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaagatattgatgaatgctccttccaaaacatttgtgtctctggaacatgtaataacctgcctggaatgtttcattgcatctgcgatgatggttatgaattggacagaacaggagggaactgtacagatattgatgagtgtgcagatcctataaactgtgtcaatggcctatgtgtcaacacgcctggtcgctatgagtgtaactgcccacccgattttcagttgaacccaactggtgtgggttgtgttgacaaccgtgtgggcaactgctacctgaagtttggacctcgaggagatgggagtctgtcttgcaacaccgagatcggggtgggcgtcagtcgctcttcatgctgctgctctctgggaaaggcctggggaaacccctgtgagacatgcccccctgtcaatagcactgaatattacaccctgtgtcccggaggtgaaggcttcagacctaaccccatcacaatcattttagaagacattgacgaatgccaggagttaccaggtctctgccagggtggaaactgcatcaacacttttgggagcttccagtgtgagtgcccacaaggctactacctcagcgaggatacccgcatctgtgaggatattgatgagtgttttgcacatcctggtgtgtgtgggcctgggacctgctataacaccctgggaaattacacctgcatttgcccacctgagtacatgcaggtcaatggaggccacaactgcatggacatgagaaaaagcttttgctaccgaagctataatggaaccacttgtgagaatgagttgcctttcaatgtgacaaaaaggatgtgctgctgcacatataatgtgggcaaagcttggaacaaaccttgtgaaccatgcccaactccaggaacagctgactttaaaaccatatgtggaaatattcctggattcacctttgacattcacacaggaaaagctgttgacattgatgaatgtaaagagattccaggcatttgtgcaaatggtgtgtgcattaaccagattggcagtttccgctgtgaatgccctacaggattcagttacaatgacctgctgttggtttgtgaagatatagatgagtgcagcaatggtgataatctctgccagcggaatgcagactgcatcaatagtcctggtagttaccgctgtgaatgtgccgcgggtttcaaactttcacccaatggggcctgtgtagatcgcaatgaatgtttagaaattcctaacgtttgcagtcatggcttgtgtgttgatctgcaaggaagttaccagtgcatctgccacaatggctttaaggcttctcaggaccagaccatgtgcatggatgttgatgagtgcgagcggcatccatgtggaaatggaacttgtaaaaacaccgttggatctacagatgtggctgcccccaaggctacatccagcactaccagtggaatcagtgtgtcgatgagaatgaatgctccaatcccaatgcctgtggctctgcttcctgctacaacaccctggggagttacaagtgcgcctgcccctcggggttctccttcgaccagttctccagtgcctgccacgacgtgaatgagtgctcgtcctccaagaacccctgcaattacggctgctctaacacggaggggggctacctctgtggctgcccccctgggtattacagagtgggacaaggccactgtgtctcaggaatgggatttaacaaggggcagtacctgtcactggatacagaggtcgatgaggaaaatgctctgtccccagaagcatgctacgagtgcaaaatcaacggctattctaagaaagacagcaggcagaagagaagtattcatgaacctgatcccactgctgttgaacagatcagcctagagagtgtcgacatggacagccccgtcaacatgaagttcaacctctcccacctcggctctaaggagcacatcctggaactaaggcccgccatccagcccctcaacaaccacatccgttatgtcatctctcaagggaacgatgacagcgtcttccgcatccaccaaaggaatgggctcagctacttgcacacggccaagaagaagctcatgcccggcacatacacactggaaatcactagcatccctctctacaagaagaaggagcttaagaaactggaagagagcaatgaggatgactacctcctaggggagcttggggaggctctcagaatgaggctgcagattcagctctattaacccttcacagacttgggcccaggctcaaatcctagcacagccagtctgcagaagcatttgaaaagtcaaggactaattttaaagaggaaaaataataataactcttgtttctttcctccctgtcttagactttgaatgttgaccctcacagggagggataatttagactctggtatggccaaagatttgagcacaaaggcaaccgtggttactgtattttttatataacttcattttaaaatatattaaaagaaacctaaatgttcaagatatcagcatatggcactaaatgcacaaaaataatgtgagctttttttttttttcctgttagcagtctgtaacactttgggtattttgctatagttgctaattaaaaaaatatagatgtttatttatttttaatgcagtaatatatggagaaatgaacaaactatgtaaacaaaaagggaaactcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaagacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtactgtaggcagctgaagaaccgccgttcccttgaaagggaacacctggcattctgtggtgtttcgtgctgtcttaaataatggtgcatttattatgttcaagttatttcaggattgccatatgtgcaaacaaatcatgcaatgcagccaaggaatatatgttgttgttgttgttttaaacccattttttttttagaattttcattaatactgtagttatacaccatatgcctcattttatcatagcctattgtgtatgaaagatgtttgtacaatgaattgatgtttagtttgctttagtcatttaaaaagatattgtaccaggatgtgctattaagagcacgtatccattattcttctcaacccaagaacctgtttcctggaccagtgaccaaacctcatatgtgaaatggccaaagcacatgcaggctcctggttgttcctctcaaacctgtgctgaccaaagattagtaaccagttatacccagtattttgaggttttattgtttttttaataactaaaaaagaaaaaaggaacagtgtaaatttgtaatcaagagtttgtgaggaaaaacttatggtttttggttttgtttgtttttgtaggtctgtgtatcaaatatgacacttttcttgcaataaagcttattttggggta

SEQ ID NO: 454670 - DNA, 6482 bp, Homo sapiens
cgtgggttccttgcagaaggagcacctgttgaagtatgagtaccagcctttcgctgggaagatcaaagacatgcttggactgaagacagtaagaggatcgccgtggtcggggaaggaagggagaagttgggagcagtcttcctctgggatagtggctcttctgtgggcgagattacaggacacaacaaagtcatcaacagcgtggacatcaagcagagccggccataccggctggccacgggaagcgatgataactgcgcggcattctgcaaggaacccacgccaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaagatattgatgaatgctccttccaaaacatttgtgtctctggaacatgtaataacctgcctggaatgtttcattgcatctgcgatgatggttatgaattggacagaacaggagggaactgtacagatattgatgagtgtgcagatcctataaactgtgtcaatggcctatgtgtcaacacgcctggtcgctatgagtgtaactgcccacccgattttcagttgaacccaactggtgtgggttgtgttgacaaccgtgtgggcaactgctacctgaagtttggacctcgaggagatgggagtctgtcttgcaacaccgagatcggggtgggcgtcagtcgctcttcatgctgctgctctctgggaaaggcctggggaaacccctgtgagacatgcccccctgtcaatagcactgaatattacaccctgtgtcccggaggtgaaggcttcagacctaaccccatcacaatcattttagaagacattgacgaatgccaggagttaccaggtctctgccagggtggaaactgcatcaacacttttgggagcttccagtgtgagtgcccacaaggctactacctcagcgaggatacccgcatctgtgaggatattgatgagtgttttgcacatcctggtgtgtgtgggcctgggacctgctataacaccctgggaaattacacctgcatttgcccacctgagtacatgcaggtcaatggaggccacaactgcatggacatgagaaaaagcttttgctaccgaagctataatggaaccacttgtgagaatgagttgcctttcaatgtgacaaaaaggatgtgctgctgcacatataatgtgggcaaagcttggaacaaaccttgtgaaccatgcccaactccaggaacagctgactttaaaaccatatgtggaaatattcctggattcacctttgacattcacacaggaaaagctgttgacattgatgaatgtaaagagattccaggcatttgtgcaaatggtgtgtgcattaaccagattggcagtttccgctgtgaatgccctacaggattcagttacaatgacctgctgttggtttgtgaagatatagatgagtgcagcaatggtgataatctctgccagcggaatgcagactgcatcaatagtcctggtagttaccgctgtgaatgtgccgcgggtttcaaactttcacccaatggggcctgtgtagatcgcaatgaatgtttagaaattcctaacgtttgcagtcatggcttgtgtgttgatctgcaaggaagttaccagtgcatctgccacaatggctttaaggcttctcaggaccagaccatgtgcatggatgttgatgagtgcgagcggcatccatgtggaaatggaacttgtaaaaacaccgttggatcctataactgtctgtgctacccagggtttgaactcactcataataatgattgcctggacatagatgagtgcagttccttttttggtcaggtgtgcagaaatggacgttgttttaatgaaattggttctttcaagtgtctatgtaacgaaggttatgaacttaccccagatggcaaaaactgtatagacactaatgagtgtgtcgcccttcccggctcttgctctcctggtacctgtcagaatttggagggatccttcagatgcatctgtcccccagggtatgaagtaaaaagcgagaactgcattgatataaatgaatgtgatgaagatcccaacatttgtctttttggttcctgtactaatactccagggggcttccagtgcctctgcccccctggctttgtactatctgataatggacggagatgctttgatactcgccagagcttctgcttcacaaattttgaaaatggaaagtgttctgtacccaaagctttcaacaccacaaaagcaaaatgctgctgtagtaagatgccaggagagggctggggggacccctgtgagctgtgccccaaagacgatgaagttgcatttcaggatttgtgtccatatggccatggaactgtccctagtcttcatgatacacgtgaagatgtcaatgagtgtcttgagagcccaggcatttgttcaaatggtcaatgtatcaacaccgacggatcttttcgctgtgaatgtccaatgggctacaaccttgactacactggagtacgctgtgtggatactgatgagtgttcaatcggcaatccgtgtggaaatggtacatgcaccaatgttattgggagttttgaatgcaattgcaatgaaggctttgagccagggcccatgatgaattgtgaagatatcaacgaatgtgcccagaacccactgctgtgtgctttacgctgcatgaacacttttgggtcctatgaatgcacgtgcccgattggctatgccctcagggaagatcaaaagatgtgcaaagatctggatgaatgtgctgaagggttacacgactgtgaatctaggggcatgatgtgtaagaatctaatcggcaccttcatgtgcatctgccctcctggaatggcccgaaggcccgatggagaaggctgtgtagatgaaaatgaatgcaggaccaagccaggaatctgtgaaaatggacgttgtgttaacattattggaagctatagatgtgagtgtaatgaaggattccagtcaagttcttcaggcactgaatgccttgacaatcgacagggtctctgctttgcagaggtactgcagacaatatgtcaaatggcatccagtagtcgcaatctcgtcactaagtcagaatgctgctgtgatggtgggcgaggctggggccaccagtgcgagctttgcccacttcctggaactgcccagtacaaaaagatatgtcctcatggcccaggatatacaactgatggaagagatattgatgaatgtaaggtaatgccaaacctctgcaccaatggtcagtgcatcaataccatgggctcattccgatgcttctgcaaggttggctacaccacagacatcagtggaacctcttgtatagaccttgatgaatgctcccagtccccgaaaccatgcaactacatctgcaagaacactgaggggagttatcagtgttcatgtccgagggggtatgtcctgcaagaggatggaaagacatgcaaagaccttgatgaatgtcaaacaaagcagcataactgccagttcctctgtgtcaacaccctgggggggtttacctgtaaatgtccacctggtttcacacagcatcacactgcttgtatcgacaacaacgaatgtgggtctcaaccttcgctttgtggagcaaagggaatctgtcaaaacactccaggcagtttcagctgtgaatgccaaagagggttctctcttgatgccaccggactgaactgtgaagatgttgatgaatgtgatgggaaccacaggtgccaacacggctgccagaacatcctgggtggctacagatgtggctgcccccaaggctacatccagcactaccagtggaatcagtgtgtcgatgagaatgaatgctccaatcccaatgcctgtggctctgcttcctgctacaacaccctggggagttacaagtgcgcctgcccctcggggttctccttcgaccagttctccagtgcctgccacgacgtgaatgagtgctcgtcctccaagaacccctgcaattacggctgctctaacacggaggggggctacctctgtggctgcccccctgggtattacagagtgggacaaggccactgtgtctcaggaatgggatttaacaaggggcagtacctgtcactggatacagaggtcgatgaggaaaatgctctgtccccagaagcatgctacgagtgcaaaatcaacggctattctaagaaagacagcaggcagaagagaagtattcatgaacctgatcccactgctgttgaacagatcagcctagagagtgtcgacatggacagccccgtcaacatgaagttcaacctctcccacctcggctctaaggagcacatcctggaactaaggcccgccatccagcccctcaacaaccacatccgttatgtcatctctcaagggaacgatgacagcgtcttccgcatccaccaaaggaatgggctcagctacttgcacacggccaagaagaagctcatgcccggcacatacacactggaaatcactagcatccctctctacaagaagaaggagcttaagaaactggaagagagcaatgaggatgactacctcctaggggagcttggggaggctctcagaatgaggctgcagattcagctctattaacccttcacagacttgggcccaggctcaaatcctagcacagccagtctgcagaagcatttgaaaagtcaaggactaattttaaagaggaaaaataataataactcttgtttctttcctccctgtcttagactttgaatgttgaccctcacagggagggataatttagactctggtatggccaaagatttgagcacaaaggcaaccgtggttactgtattttttatataacttcattttaaaatatattaaaagaaacctaaatgttcaagatatcagcatatggcactaaatgcacaaaaataatgtgagctttttttttttttcctgttagcagtctgtaacactttgggtattttgctatagttgctaattaaaaaaatatagatgtttatttatttttaatgcagtaatatatggagaaatgaacaaactatgtaaacaaaaagggaaactcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaagacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtactgtaggcagctgaagaaccgccgttcccttgaaagggaacacctggcattctgtggtgtttcgtgctgtcttaaataatggtgcatttattatgttcaagttatttcaggattgccatatgtgcaaacaaatcatgcaatgcagccaaggaatatatgttgttgttgttgttttaaacccattttttttttagaattttcattaatactgtagttatacaccatatgcctcattttatcatagcctattgtgtatgaaagatgtttgtacaatgaattgatgtttagtttgctttagtcatttaaaaagatattgtaccaggatgtgctattaagagcacgtatccattattcttctcaacccaagaacctgtttcctggaccagtgaccaaacctcatatgtgaaatggccaaagcacatgcaggctcctggttgttcctctcaaacctgtgctgaccaaagattagtaaccagttatacccagtattttgaggttttattgtttttttaataactaaaaaagaaaaaaggaacagtgtaaatttgtaatcaagagtttgtgaggaaaaacttatggtttttggttttgtttgtttttgtaggtctgtgtatcaaatatgacacttttcttgcaataaagcttattttggggta

SEQ ID NO: 454671 - DNA, 4870 bp, Homo sapiens
agtctcgagatctagaggataaaccgaggcctggcgattccgcaaatggggtctacattaaccccatgggcaattcccgctgcgaatgccccacagtacatagtcgcagtgacccgctggtgcattgcgaagatatagatgagtgcagcaatggtgataatctctgccagcggaatgcagactgcatcaatagtcctggtagttaccgctgtgaatgtgccgcgggtttcaaactttcacccaatggggcctgtgtagatcgcaatgaatgtttagaaattcctaacgtttgcagtcatggcttgtgtgttgatctgcaaggaagttaccagtgcatctgccacaatggctttaaggcttctcaggaccagaccatgtgcatggatgttgatgagtgcgagcggcatccatgtggaaatggaacttgtaaaaacaccgttggatcctataactgtctgtgctacccagggtttgaactcactcataataatgattgcctggacatagatgagtgcagttccttttttggtcaggtgtgcagaaatggacgttgttttaatgaaattggttctttcaagtgtctatgtaacgaaggttatgaacttaccccagatggcaaaaactgtatagacactaatgagtgtgtcgcccttcccggctcttgctctcctggtacctgtcagaatttggagggatccttcagatgcatctgtcccccagggtatgaagtaaaaagcgagaactgcattgatataaatgaatgtgatgaagatcccaacatttgtctttttggttcctgtactaatactccagggggcttccagtgcctctgcccccctggctttgtactatctgataatggacggagatgctttgatactcgccagagcttctgcttcacaaattttgaaaatggaaagtgttctgtacccaaagctttcaacaccacaaaagcaaaatgctgctgtagtaagatgccaggagagggctggggggacccctgtgagctgtgccccaaagacgatgaagttgcatttcaggatttgtgtccatatggccatggaactgtccctagtcttcatgatacacgtgaagatgtcaatgagtgtcttgagagcccaggcatttgttcaaatggtcaatgtatcaacaccgacggatcttttcgctgtgaatgtccaatgggctacaaccttgactacactggagtacgctgtgtggatactgatgagtgttcaatcggcaatccgtgtggaaatggtacatgcaccaatgttattgggagttttgaatgcaattgcaatgaaggctttgagccagggcccatgatgaattgtgaagatatcaacgaatgtgcccagaacccactgctgtgtgctttacgctgcatgaacacttttgggtcctatgaatgcacgtgcccgattggctatgccctcagggaagatcaaaagatgtgcaaagatctggatgaatgtgctgaagggttacacgactgtgaatctaggggcatgatgtgtaagaatctaatcggcaccttcatgtgcatctgccctcctggaatggcccgaaggcccgatggagaaggctgtgtagatgaaaatgaatgcaggaccaagccaggaatctgtgaaaatggacgttgtgttaacattattggaagctatagatgtgagtgtaatgaaggattccagtcaagttcttcaggcactgaatgccttgacaatcgacagggtctctgctttgcagaggtactgcagacaatatgtcaaatggcatccagtagtcgcaatctcgtcactaagtcagaatgctgctgtgatggtgggcgaggctggggccaccagtgcgagctttgcccacttcctggaactgcccagtacaaaaagatatgtcctcatggcccaggatatacaactgatggaagagatattgatgaatgtaaggtaatgccaaacctctgcaccaatggtcagtgcatcaataccatgggctcattccgatgcttctgcaaggttggctacaccacagacatcagtggaacctcttgtatagaccttgatgaatgctcccagtccccgaaaccatgcaactacatctgcaagaacactgaggggagttatcagtgttcatgtccgagggggtatgtcctgcaagaggatggaaagacatgcaaagaccttgatgaatgtcaaacaaagcagcataactgccagttcctctgtgtcaacaccctgggggggtttacctgtaaatgtccacctggtttcacacagcatcacactgcttgtatcgacaacaacgaatgtgggtctcaaccttcgctttgtggagcaaagggaatctgtcaaaacactccaggcagtttcagctgtgaatgccaaagagggttctctcttgatgccaccggactgaactgtgaagatgttgatgaatgtgatgggaaccacaggtgccaacacggctgccagaacatcctgggtggctacagatgtggctgcccccaaggctacatccagcactaccagtggaatcagtgtgtcgatgagaatgaatgctccaatcccaatgcctgtggctctgcttcctgctacaacaccctggggagttacaagtgcgcctgcccctcggggttctccttcgaccagttctccagtgcctgccacgacgtgaatgagtgctcgtcctccaagaacccctgcaattacggctgctctaacacggaggggggctacctctgtggctgcccccctgggtattacagagtgggacaaggccactgtgtctcaggaatgggatttaacaaggggcagtacctgtcactggatacagaggtcgatgaggaaaatgctctgtccccagaagcatgctacgagtgcaaaatcaacggctattctaagaaagacagcaggcagaagagaagtattcatgaacctgatcccactgctgttgaacagatcagcctagagagtgtcgacatggacagccccgtcaacatgaagttcaacctctcccacctcggctctaaggagcacatcctggaactaaggcccgccatccagcccctcaacaaccacatccgttatgtcatctctcaagggaacgatgacagcgtcttccgcatccaccaaaggaatgggctcagctacttgcacacggccaagaagaagctcatgcccggcacatacacactggaaatcactagcatccctctctacaagaagaaggagcttaagaaactggaagagagcaatgaggatgactacctcctaggggagcttggggaggctctcagaatgaggctgcagattcagctctattaacccttcacagacttgggcccaggctcaaatcctagcacagccagtctgcagaagcatttgaaaagtcaaggactaattttaaagaggaaaaataataataactcttgtttctttcctccctgtcttagactttgaatgttgaccctcacagggagggataatttagactctggtatggccaaagatttgagcacaaaggcaaccgtggttactgtattttttatataacttcattttaaaatatattaaaagaaacctaaatgttcaagatatcagcatatggcactaaatgcacaaaaataatgtgagctttttttttttttcctgttagcagtctgtaacactttgggtattttgctatagttgctaattaaaaaaatatagatgtttatttatttttaatgcagtaatatatggagaaatgaacaaactatgtaaacaaaaagggaaactcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaagacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtactgtaggcagctgaagaaccgccgttcccttgaaagggaacacctggcattctgtggtgtttcgtgctgtcttaaataatggtgcatttattatgttcaagttatttcaggattgccatatgtgcaaacaaatcatgcaatgcagccaaggaatatatgttgttgttgttgttttaaacccattttttttttagaattttcattaatactgtagttatacaccatatgcctcattttatcatagcctattgtgtatgaaagatgtttgtacaatgaattgatgtttagtttgctttagtcatttaaaaagatattgtaccaggatgtgctattaagagcacgtatccattattcttctcaacccaagaacctgtttcctggaccagtgaccaaacctcatatgtgaaatggccaaagcacatgcaggctcctggttgttcctctcaaacctgtgctgaccaaagattagtaaccagttatacccagtattttgaggttttattgtttttttaataactaaaaaagaaaaaaggaacagtgtaaatttgtaatcaagagtttgtgaggaaaaacttatggtttttggttttgtttgtttttgtaggtctgtgtatcaaatatgacacttttcttgcaataaagcttattttggggta

SEQ ID NO: 454672 - DNA, 10141 bp, Homo sapiens
atggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaactcagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaagatataaatgaatgtgaaagcaacccatgtgtcaatggggcctgcagaaacaaccttggatctttcaattgtgaatgttcgcccggcagcaaactcagctccacaggattgatctgtattgacagcctgaaggggacctgttggctcaacatccaggacagccgctgtgaggtgaatattaatggagccactctgaaatctgaatgctgtgccaccctcggagccgcctgggggagcccctgtgagcggtgtgaactagatacagcttgcccaagagggcttgccaggattaaaggtgttacgtgtgaagatgttaatgagtgtgaggtgttccctggcgtttgtccaaatggacgctgtgtcaacagtaagggatcttttcattgcgagtgccctgaaggccttacgttggatgggactggccgtgtatgtttggatattcgcatggagcagtgttacttgaagtgggatgaagatgaatgcatccaccccgttcctggaaagttccgcatggatgcctgctgctgtgctgtcggggcggcttggggcaccgagtgtgaggagtgccccaaacctggcaccaaggaatacgagacactgtgcccccgcggggctggctttgctaaccgaggggatgttcttactgggcggccattttacaaagacatcaatgaatgcaaagcatttcctgggatgtgcacttatgggaagtgcagaaatacaatcggaagcttcaaatgccgttgcaatagtggctttgctctagacatggaggaaagaaactgcacggacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaagatattgatgaatgctccttccaaaacatttgtgtctctggaacatgtaataacctgcctggaatgtttcattgcatctgcgatgatggttatgaattggacagaacaggagggaactgtacagatattgatgagtgtgcagatcctataaactgtgtcaatggcctatgtgtcaacacgcctggtcgctatgagtgtaactgcccacccgattttcagttgaacccaactggtgtgggttgtgttgacaaccgtgtgggcaactgctacctgaagtttggacctcgaggagatgggagtctgtcttgcaacaccgagatcggggtgggcgtcagtcgctcttcatgctgctgctctctgggaaaggcctggggaaacccctgtgagacatgcccccctgtcaatagcactgaatattacaccctgtgtcccggaggtgaaggcttcagacctaaccccatcacaatcattttagaagacattgacgaatgccaggagttaccaggtctctgccagggtggaaactgcatcaacacttttgggagcttccagtgtgagtgcccacaaggctactacctcagcgaggatacccgcatctgtgaggatattgatgagtgttttgcacatcctggtgtgtgtgggcctgggacctgctataacaccctgggaaattacacctgcatttgcccacctgagtacatgcaggtcaatggaggccacaactgcatggacatgagaaaaagcttttgctaccgaagctataatggaaccacttgtgagaatgagttgcctttcaatgtgacaaaaaggatgtgctgctgcacatataatgtgggcaaagcttggaacaaaccttgtgaaccatgcccaactccaggaacagctgactttaaaaccatatgtggaaatattcctggattcacctttgacattcacacaggaaaagctgttgacattgatgaatgtaaagagattccaggcatttgtgcaaatggtgtgtgcattaaccagattggcagtttccgctgtgaatgccctacaggattcagttacaatgacctgctgttggtttgtgaagatatagatgagtgcagcaatggtgataatctctgccagcggaatgcagactgcatcaatagtcctggtagttaccgctgtgaatgtgccgcgggtttcaaactttcacccaatggggcctgtgtagatcgcaatgaatgtttagaaattcctaacgtttgcagtcatggcttgtgtgttgatctgcaaggaagttaccagtgcatctgccacaatggctttaaggcttctcaggaccagaccatgtgcatggatgttgatgagtgcgagcggcatccatgtggaaatggaacttgtaaaaacaccgttggatcctataactgtctgtgctacccagggtttgaactcactcataataatgattgcctggacatagatgagtgcagttccttttttggtcaggtgtgcagaaatggacgttgttttaatgaaattggttctttcaagtgtctatgtaacgaaggttatgaacttaccccagatggcaaaaactgtatagacactaatgagtgtgtcgcccttcccggctcttgctctcctggtacctgtcagaatttggagggatccttcagatgcatctgtcccccagggtatgaagtaaaaagcgagaactgcattgatataaatgaatgtgatgaagatcccaacatttgtctttttggttcctgtactaatactccagggggcttccagtgcctctgcccccctggctttgtactatctgataatggacggagatgctttgatactcgccagagcttctgcttcacaaattttgaaaatggaaagtgttctgtacccaaagctttcaacaccacaaaagcaaaatgctgctgtagtaagatgccaggagagggctggggggacccctgtgagctgtgccccaaagacgatgaagttgcatttcaggatttgtgtccatatggccatggaactgtccctagtcttcatgatacacgtgaagatgtcaatgagtgtcttgagagcccaggcatttgttcaaatggtcaatgtatcaacaccgacggatcttttcgctgtgaatgtccaatgggctacaaccttgactacactggagtacgctgtgtggatactgatgagtgttcaatcggcaatccgtgtggaaatggtacatgcaccaatgttattgggagttttgaatgcaattgcaatgaaggctttgagccagggcccatgatgaattgtgaagatatcaacgaatgtgcccagaacccactgctgtgtgctttacgctgcatgaacacttttgggtcctatgaatgcacgtgcccgattggctatgccctcagggaagatcaaaagatgtgcaaagatctggatgaatgtgctgaagggttacacgactgtgaatctaggggcatgatgtgtaagaatctaatcggcaccttcatgtgcatctgccctcctggaatggcccgaaggcccgatggagaaggctgtgtagatgaaaatgaatgcaggaccaagccaggaatctgtgaaaatggacgttgtgttaacattattggaagctatagatgtgagtgtaatgaaggattccagtcaagttcttcaggcactgaatgccttgacaatcgacagggtctctgctttgcagaggtactgcagacaatatgtcaaatggcatccagtagtcgcaatctcgtcactaagtcagaatgctgctgtgatggtgggcgaggctggggccaccagtgcgagctttgcccacttcctggaactgcccagtacaaaaagatatgtcctcatggcccaggatatacaactgatggaagagatattgatgaatgtaaggtaatgccaaacctctgcaccaatggtcagtgcatcaataccatgggctcattccgatgcttctgcaaggttggctacaccacagacatcagtggaacctcttgtatagaccttgatgaatgctcccagtccccgaaaccatgcaactacatctgcaagaacactgaggggagttatcagtgttcatgtccgagggggtatgtcctgcaagaggatggaaagacatgcaaagaccttgatgaatgtcaaacaaagcagcataactgccagttcctctgtgtcaacaccctgggggggtttacctgtaaatgtccacctggtttcacacagcatcacactgcttgtatcgacaacaacgaatgtgggtctcaaccttcgctttgtggagcaaagggaatctgtcaaaacactccaggcagtttcagctgtgaatgccaaagagggttctctcttgatgccaccggactgaactgtgaagatgttgatgaatgtgatgggaaccacaggtgccaacacggctgccagaacatcctgggtggctacagatgtggctgcccccaaggctacatccagcactaccagtggaatcagtgtgtcgatgagaatgaatgctccaatcccaatgcctgtggctctgcttcctgctacaacaccctggggagttacaagtgcgcctgcccctcggggttctccttcgaccagttctccagtgcctgccacgacgtgaatgagtgctcgtcctccaagaacccctgcaattacggctgctctaacacggaggggggctacctctgtggctgcccccctgggtattacagagtgggacaaggccactgtgtctcaggaatgggatttaacaaggggcagtacctgtcactggatacagaggtcgatgaggaaaatgctctgtccccagaagcatgctacgagtgcaaaatcaacggctattctaagaaagacagcaggcagaagagaagtattcatgaacctgatcccactgctgttgaacagatcagcctagagagtgtcgacatggacagccccgtcaacatgaagttcaacctctcccacctcggctctaaggagcacatcctggaactaaggcccgccatccagcccctcaacaaccacatccgttatgtcatctctcaagggaacgatgacagcgtcttccgcatccaccaaaggaatgggctcagctacttgcacacggccaagaagaagctcatgcccggcacatacacactggaaatcactagcatccctctctacaagaagaaggagcttaagaaactggaagagagcaatgaggatgactacctcctaggggagcttggggaggctctcagaatgaggctgcagattcagctctattaacccttcacagacttgggcccaggctcaaatcctagcacagccagtctgcagaagcatttgaaaagtcaaggactaattttaaagaggaaaaataataataactcttgtttctttcctccctgtcttagactttgaatgttgaccctcacagggagggataatttagactctggtatggccaaagatttgagcacaaaggcaaccgtggttactgtattttttatataacttcattttaaaatatattaaaagaaacctaaatgttcaagatatcagcatatggcactaaatgcacaaaaataatgtgagctttttttttttttcctgttagcagtctgtaacactttgggtattttgctatagttgctaattaaaaaaatatagatgtttatttatttttaatgcagtaatatatggagaaatgaacaaactatgtaaacaaaaagggaaactcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaagacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtactgtaggcagctgaagaaccgccgttcccttgaaagggaacacctggcattctgtggtgtttcgtgctgtcttaaataatggtgcatttattatgttcaagttatttcaggattgccatatgtgcaaacaaatcatgcaatgcagccaaggaatatatgttgttgttgttgttttaaacccattttttttttagaattttcattaatactgtagttatacaccatatgcctcattttatcatagcctattgtgtatgaaagatgtttgtacaatgaattgatgtttagtttgctttagtcatttaaaaagatattgtaccaggatgtgctattaagagcacgtatccattattcttctcaacccaagaacctgtttcctggaccagtgaccaaacctcatatgtgaaatggccaaagcacatgcaggctcctggttgttcctctcaaacctgtgctgaccaatgttttttgatttttttttttcttttttttttttttttttttttttttt

SEQ ID NO: 454673 - DNA, 8289 bp, Homo sapiens
atggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaactcagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaagatataaatgaatgtgaaagcaacccatgtgtcaatggggcctgcagaaacaaccttggatctttcaattgtgaatgttcgcccggcagcaaactcagctccacaggattgatctgtattgacagcctgaaggggacctgttggctcaacatccaggacagccgctgtgaggtgaatattaatggagccactctgaaatctgaatgctgtgccaccctcggagccgcctgggggagcccctgtgagcggtgtgaactagatacagcttgcccaagagggcttgccaggattaaaggtgttacgtgtgaagatgttaatgagtgtgaggtgttccctggcgtttgtccaaatggacgctgtgtcaacagtaagggatcttttcattgcgagtgccctgaaggccttacgttggatgggactggccgtgtatgtttggatattcgcatggagcagtgttacttgaagtgggatgaagatgaatgcatccaccccgttcctggaaagttccgcatggatgcctgctgctgtgctgtcggggcggcttggggcaccgagtgtgaggagtgccccaaacctggcaccaaggaatacgagacactgtgcccccgcggggctggctttgctaaccgaggggatgttcttactgggcggccattttacaaagacatcaatgaatgcaaagcatttcctgggatgtgcacttatgggaagtgcagaaatacaatcggaagcttcaaatgccgttgcaatagtggctttgctctagacatggaggaaagaaactgcacggacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaagatattgatgaatgctccttccaaaacatttgtgtctctggaacatgtaataacctgcctggaatgtttcattgcatctgcgatgatggttatgaattggacagaacaggagggaactgtacagatattgatgagtgtgcagatcctataaactgtgtcaatggcctatgtgtcaacacgcctggtcgctatgagtgtaactgcccacccgattttcagttgaacccaactggtgtgggttgtgttgacaaccgtgtgggcaactgctacctgaagtttggacctcgaggagatgggagtctgtcttgcaacaccgagatcggggtgggcgtcagtcgctcttcatgctgctgctctctgggaaaggcctggggaaacccctgtgagacatgcccccctgtcaatagcactgaatattacaccctgtgtcccggaggtgaaggcttcagacctaaccccatcacaatcattttagaagacattgacgaatgccaggagttaccaggtctctgccagggtggaaactgcatcaacacttttgggagcttccagtgtgagtgcccacaaggctactacctcagcgaggatacccgcatctgtgaggatattgatgagtgttttgcacatcctggtgtgtgtgggcctgggacctgctataacaccctgggaaattacacctgcatttgcccacctgagtacatgcaggtcaatggaggccacaactgcatggacatgagaaaaagcttttgctaccgaagctataatggaaccacttgtgagaatgagttgcctttcaatgtgacaaaaaggatgtgctgctgcacatataatgtgggcaaagcttggaacaaaccttgtgaaccatgcccaactccaggaacagctgactttaaaaccatatgtggaaatattcctggattcacctttgacattcacacaggaaaagctgttgacattgatgaatgtaaagagattccaggcatttgtgcaaatggtgtgtgcattaaccagattggcagtttccgctgtgaatgccctacaggattcagttacaatgacctgctgttggtttgtgaagatatagatgagtgcagcaatggtgataatctctgccagcggaatgcagactgcatcaatagtcctggtagttaccgctgtgaatgtgccgcgggtttcaaactttcacccaatggggcctgtgtagatcgcaatgaatgtttagaaattcctaacgtttgcagtcatggcttgtgtgttgatctgcaaggaagttaccagtgcatctgccacaatggctttaaggcttctcaggaccagaccatgtgcatggatgttgatgagtgcgagcggcatccatgtggaaatggaacttgtaaaaacaccgttggatcctataactgtctgtgctacccagggtttgaactcactcataataatgattgcctggacatagatgagtgcagttccttttttggtcaggtgtgcagaaatggacgttgttttaatgaaattggttctttcaagtgtctatgtaacgaaggttatgaacttaccccagatggcaaaaactgtatagacactaatgagtgtgtcgcccttcccggctcttgctctcctggtacctgtcagaatttggagggatccttcagatgcatctgtcccccagggtatgaagtaaaaagcgagaactgcattgatataaatgaatgtgatgaagatcccaacatttgtctttttggttcctgtactaatactccagggggcttccagtgcctctgcccccctggctttgtactatctgataatggacggagatgctttgatactcgccagagcttctgcttcacaaattttgaaaatggaaagtgttctgtacccaaagctttcaacaccacaaaagcaaaatgctgctgtagtaagatgccaggagagggctggggggacccctgtgagctgtgccccaaagacgatgaagttgcatttcaggatttgtgtccatatggccatggaactgtccctagtcttcatgatacacgtgaagatgtcaatgagtgtcttgagagcccaggcatttgttcaaatggtcaatgtatcaacaccgacggatcttttcgctgtgaatgtccaatgggctacaaccttgactacactggagtacgctgtgtggatactgatgagtgttcaatcggcaatccgtgtggaaatggtacatgcaccaatgttattgggagttttgaatgcaattgcaatgaaggctttgagccagggcccatgatgaattgtgaagatatcaacgaatgtgcccagaacccactgctgtgtgctttacgctgcatgaacacttttgggtcctatgaatgcacgtgcccgattggctatgccctcagggaagatcaaaagatgtgcaaagatctggatgaatgtgctgaagggttacacgactgtgaatctaggggcatgatgtgtaagaatctaatcggcaccttcatgtgcatctgccctcctggaatggcccgaaggcccgatggagaaggctgtgtagatgaaaatgaatgcaggaccaagccaggaatctgtgaaaatggacgttgtgttaacattattggaagctatagatgtgagtgtaatgaaggattccagtcaagttcttcaggcactgaatgccttgacaatcgacagggtctctgctttgcagaggtactgcagacaatatgtcaaatggcatccagtagtcgcaatctcgtcactaagtcagaatgctgctgtgatggtgggcgaggctggggccaccagtgcgagctttgcccacttcctggaactgcccagtacaaaaagatatgtcctcatggcccaggatatacaactgatggaagagatattgatgaatgtaaggtaatgccaaacctctgcaccaatggtcagtgcatcaataccatgggctcattccgatgcttctgcaaggttggctacaccacagacatcagtggaacctcttgtatagaccttgatgaatgctcccagtccccgaaaccatgcaactacatctgcaagaacactgaggggagttatcagtgttcatgtccgagggggtatgtcctgcaagaggatggaaagacatgcaaagaccttgatgaatgtcaaacaaagcagcataactgccagttcctctgtgtcaacaccctgggggggtttacctgtaaatgtccacctggtttcacacagcatcacactgcttgtatcgacaacaacgaatgtgggtctcaaccttcgctttgtggagcaaagggaatctgtcaaaacactccaggcagtttcagctgtgaatgccaaagagggttctctcttgatgccaccggactgaactgtgaagatgttgatgaatgtgatgggaaccacaggtgccaacacggctgccagaacatcctgggtggctacagatgtggctgcccccaaggctacatccagcactaccagtggaatcagtgtgtcgatgagaatgaatgctccaatcccaatgcctgtggctctgcttcctgctacaacaccctggggagttacaagtgcgcctgcccctcggggttctccttcgaccagttctccagtgcctgccacgacgtgaatgagtgctcgtcctccaagaacccctgcaattacggctgctctaacacggaggggggctacctctgtggctgcccccctgggtattacagagtgggacaagggtaaggcggccttcagcctcagcacatagaggaatacatggttcctgctctgccgttgggtgagggcatggggtatcgagctctggtgctgcgtcct

SEQ ID NO: 454674 - DNA, 2716 bp, Homo sapiens
atggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaactcagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaaggtaagagctgtcttcatcgccttatttgtgcatagtgagtacctggagttgtataaacatcaattacagtgatgaagcaatgtagtgaaaagaatattgtttgaatattttattttataatctcatttagctaatctgccagtttttgaaatagtaaggacc

SEQ ID NO: 454675 - DNA, 1319 bp, Homo sapiens
atggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaaggtgagtctctctactttgggaagcatgcctaattgtgactttaatgcaagaaaaacaggacttcatttgaaattttgaagactactggtcacaattaaaactctttatctactatgaaagcataggtttaagcctagagtagttctgtgtttgtgtattgtagccttagtgggtttgatttgaaaagagtcaatgagcatttgcatctagtttgttatctcagttgtgttgcattgagaatgggagtaatccagccatttatgtttcttcttaataaagtaggtttccatttcacttataaagttatatcaaaaacgaaaattgagatagaaataagaagtccaagtgaaatacagtatcatgtgta

SEQ ID NO: 454676 - DNA, 4142 bp, Homo sapiens
tgataggtgggggcgactgggccaggcgccggggcaggaagggaggcggccgccgtgccattcttaaaggcgcccgagtgtaggcgacaggccgctgacggccggaaggaaaatgagtgagtctttggttgtttgtgatgttgccgaagatttagtggaaaagctgagaaagtttcgttttcgcaaagaaacgaacaacgctgctattataatgaagattgacaaggataaacgcctggtggtactggatgaggagcttgagggcatttcaccagatgaacttaaagatgaactacctgaacgacaacctcgcttcattgtgtatagttataaatatcaacatgatgatggaagagtttcatatcctctgtgctttattttctccagtcctgttggatgtaagcctgaacaacagatgatgtatgctggaagtaagaataagctagtccagacagctgaactaaccaaggtatttgaaataagaaataccgaagacctaactgaagaatggttacgtgagaaacttggattttttcactaatgtgaacttctgtgtttctaaagtatttatgtattaacctgaccatactggaatcagacataaatacttatttatgcctaaaaatgcactgttacttacagtttgtttcctgcagtaaagaaaaattcttcatttgtgcaaaatttgaacaaagaggaaatcatcttcatagtaatgaaactttgtaaagtgtttccttatattggtaattgttaggtggactacttttctccagggactttttgcactcttgtgactaatttctataacttatggttcggaatttgttactatttacagacaccattggaaagtggatatattagattgtgagagacaacagttgcctccttttgacaaatactggatattagcagtttatttatgaaaatagcgtattatcacttgtcaaatcattgaaattcatttggggtcaaagacttgagtgacccagtattgagccatgaataatttagtgtaacctgtattacaagtacattgatgaattctgtatcttctttggtttcctgtatctttttaatcaagtctagaaactatgttcatcagtcactcatttttaaggtcgggagttagattttatgatagaattatgactgttagcttttctccttatagcatcttagtcttagaaattggtgggttgtaataatcaagggcttcattccttttatgtcatttctagacagttttgaatctaggttaataacactttatttataaagcacctcaatgtcctgtgaacactaattattttaaatgtgttaatactgtgcctttgatttgttagctttaaagttagtttaagacttttacactgccagtattccacatttggtgaaattaatacttttttaaagggtccaaataaaataattttctaatgtgtatatctgaaatttgtaataaaatcaacttcatattttaaaaattccaactatctgcttgcattggtgaatatatggcagtcgagagttataattttgggtatacttgtggttagttttgtgccataggaaaaaattatcttaaaactttggccatagttaataacattaacacttcaatagcaatcacatcttatatcctaaatgtcagaagatattctgaactggatgcctgaatagttaactaaaccagtcttgttagatgatggtactcttggcataaagcgaggattctgatatttggcatacttgtaaaaacaaatacataagtaaccattgaacattaatttgataataggtctagagactctaaaaactaaccaaacttggtgagtgtattcttatattaagaatatcttagtcatctcaaaactagcaaaatttaaattttggcatgttttccattcatatgttctttgcattttatttttgaggtttctgtgagaagtaaagatagttggaatttttgcgatattgaatagaacatcttctgttcccaacactgtttggcttcactaatttagaagtcaggaagcaatagaaagttggagatgaggaagtgctagagtaggtgtttgttttggttcttggagggaaaagattctttattccaatttccagagagaagagaaaactcacccaggaagtttaaaaattctttaaacaggtattttgatattggagaataacatgcatataattctgtaggaatgcacatgtaatccaagtgagtggagagtgtttttaatgtttttgaatgaaggaaatgaggttttgtttcacctgttttgcagcagtaagagaaactagtgctgcaagaatgtattttttaatgaagttccttattttgtcttgcatgttttagttttgcttatttttaaatttggaggtcctccataatgtcagataatattgacctgccatacgttagcactcttagttccgctactgtctttaacaggagcaaagagctgtgataaaccatgcttttttgagcttgtctgactcctaattaataacatgtttttggcaagacaacagattgaggttagaggatcagtaggacatttttattccatctgtcctatggggaaatttacaaatcccgtgctctaaaatgttctcaaacatttatatagatttccctttcatcttactaaattttgcattgttcttttcaagtatgtttcgtatttactgtctttttttctgccatttcccaaataataactccagatttcataattccagtttttacattccgttatctttctggtacaaccattcccattcagccttaaatctgagtcctttttagcagcaacttttttcctgggatcctccttcgtggtcttctaagtcagtgttagttttgaaatttttggccctgcataagttctgcatagcatctaatgtcaaaatagaaccaactggtaatcacagtattatttagtgtggtttccatgacaacaaaaatacatacgaagaaaacttctcaggttactatgctgaaattccaaaatgtctgagttttgaatagtgatcactttgttctggtattgacgcaattatattaggaaaaaagttggttgactgtttttgtttaattgacttctaaaatgttcaaattgtctagttctaaaagtttactaaatgcctagtgcagttaaacatactcttgtttaagtgtgtgttgctaaattttttactgtcattactaaataatctgtgtggcaaaatgtgtgtcagcacttttccctccttttttatctcctattttcaggagtcaaatgtagccataaactgtatccttgtctgacactttagctaaaaatttccagttaggggagtttattgccaaattaaatttggctgttccccccaacccatatagatattaaggaaggtgtacttaaaaaatgtttggactgcttttaaaacctgagcaatgtcattaatccatatgtggactagtgatgaatagatattttcataagagtttaaatgctgatatttggtggaagtagagagtaactcatattctatcaattcaagtattcttactatggttgctttccctatttgttcaatagactgataatactggaatttatagagtttgagccattacaacttttgtgaggatgtgtttcaaacatttctggacaaatcttattttgtatttctggaagaatgtagtaatcttctagaccgcttaaaaccaatgctcccaagctgaatattcttgagaaatttgtttttattatgccatttgacatttcaaatcagtgctcatatacagtaaacttgtgatagaaattgtattttattgctttttggattataattcatataaatataattacttgaatattgtttgagatcattaacatgccagggcagttcccactgatttagatggtccaagataatctcattcaggaggcttgaaacattaatggtttagtcttgtgaattttaacagttctctgtcatcgtttaacaaaaccaacaactgacacaactccttaagctgtggtttcagtctctgctagttcatattgcatgtttattttggacagtcttttgttaagcatggtgcttgtactggtttaaataaaatgttaacattaaaa

SEQ ID NO: 454677 - DNA, 1489 bp, Homo sapiens
tgataggtgggggcgactgggccaggcgccggggcaggaagggaggcggccgccgtgccattcttaaaggcgcccgagtgtaggcgacaggccgctgacggccggaaggaaaatgagtgagtctttggttgtttgtgatgttgccgaagatttagtggaaaagctgagaaagtttcgttttcgcaaagaaacgaacaacgctgctattataatgaagattgacaaggataaacgcctggtggtactggatgaggagcttgagggcatttcaccagatgaacttaaagatgaactacctgaacgacaacctcgcttcattgtgtatagttataaatatcaacatgatgatggaagagtttcatatcctctgtgctttattttctccagtcctgttggatgtaagcctgaacaacagatgatgtatgctggaagtaagaataagctagtccagacagctgaactaaccaaggtatttgaaataagaaataccgaagacctaactgaagaatggttacgtgagaaacttggattttttcactaatgtgaacttctgtgtttctaaagtatttatgtattaacctgaccatactggaatcagacataaatacttatttatgcctaaaaatgcactgttacttacagtttgtttcctgcagtaaagaaaaattcttcatttgtgcaaaatttgaacaaagaggaaatcatcttcatagtaatgaaactttgtaaagtgtttccttatattggtaattgttaggtggactacttttctccagggactttttgcactcttgtgactaatttctataacttatggttcggaatttgttactatttacagacaccattggaaagtggatatattagattgtgagagacaacagttgcctccttttgacaaatactggatattagcagtttatttatgaaaatagcgtattatcacttgtcaaatcattgaaattcatttggggtcaaagacttgagtgacccagtattgagccatgaataatttagtgtaacctgtattacaagtacattgatgaattctgtatcttctttggtttcctgtatctttttaatcaagtctagaaactatgttcatcagtcactcatttttaaggtcgggagttagattttatgatagaattatgactgttagcttttctccttatagcatcttagtcttagaaattggtgggttgtaataatcaagggcttcattccttttatgtcatttctagacagttttgaatctaggttaataacactttatttataaagcacctcaatgtcctgtgaacactaattattttaaatgtgttaatactgtgcctttgatttgttagctttaaagttagtttaagacttttacactgccagtattccacatttggtgaaattaatacttttttaaagggtccaaataaaataattttctaatgtgtatatctgaaatttgtaataaaatcaacttcatattttaaaa

SEQ ID NO: 454678 - DNA, 970 bp, Homo sapiens
tgataggtgggggcgactgggccaggcgccggggcaggaagggaggcggccgccgtgccattcttaaaggcgcccgagtgtaggcgacaggccgctgacggccggaaggaaaatgagtgagtctttggttgtttgtgatgttgccgaagatttagtggaaaagctgagaaagtttcgttttcgcaaagaaacgaacaacgctgctattataagtaagctaaaagtgattgcctcaaagttacatggtcttaatttgtttttaatcttgtagctacattgaatgaactgaaccgttggaaagcaatgttacttcctctgtttcatttccccaccaccacctttagatcactttaaaaaataagtaacagctaattctaatgtcacagaacagaggtggattgtcccacctcccccatagtccttttatcagctgcctgtacagctctggagaaggcggtcgtcttggtccttgggtaatgaggattcccatctgcagtgacccatccaacccatccttcttgggggactaaaaatagcctggccattcatcctcaaatagaaacctttgcctacacctaaaatgacaaagttcagcattgtgtacatagtgactttgggcattattccagttgtagatttgaactctggtttcaggaagagtacttttaagtggcactggcactatcttctgaaaatggaaaaagtgatttgcatattgctcctcccactgtgagctatatctgacattatgcagatttcccttgtattcataggcagtatttaatatgtaggtagtgatttagaaagatgaggaaaggatgagggggtgaaaatgtaaaactctagagaccatgcttaacagagatgcatctggcagatgtgatttaatcagaggtcatgacaacttgtcatgaattctgatttcattataaataaatactgcaatgtcgacatatggttcttaaaagtg

SEQ ID NO: 454679 - DNA, 4358 bp, Homo sapiens
tgataggtgggggcgactgggccaggcgccggggcaggaagggaggcggccgccgtgccattcttaaaggcgcccgagtgtaggcgacaggccgctgacggccggaaggaaaatgagtgagtctttggttgtttgtgatgttgccgaagatttagtggaaaagctgagaaagtttcgttttcgcaaagaaacgaacaacgctgctattataatgaagattgacaaggataaacgcctggtggtactggatgaggagcttgagggcatttcaccagatgaacttaaagatgaactacctgaacgacaacctcgcttcattgtgtatagttataaatatcaacatgatgatggaagagtttcatatcctctgtgctttattttctccagtcctgttggatgtaagcctgaacaacagatgatgtatgctggaagtaagaataagctagtccagacagctgaactaaccaaggtatttgaaataagaaataccgaagacctaactgaagaatggttacgtgagaaacttggattttttcactaatgtgaacttctgtgtttctaaagtatttatgtattaacctgaccatactggaatcagacataaatacttatttatgcctaaaaatgcactgttacttacagtttgtttcctgcagtaaagaaaaattcttcatttgtgcaaaatttgaacaaagaggaaatcatcttcatagtaatgaaactttgtaaagtgtttccttatattggtaattgttaggtggactacttttctccagggactttttgcactcttgtgactaatttctataacttatggttcggaatttgttactatttacagacaccattggaaagtggatatattagattgtgagagacaacagttgcctccttttgacaaatactggatattagcagtttatttatgaaaatagcgtattatcacttgtcaaatcattgaaattcatttggggtcaaagacttgagtgacccagtattgagccatgaataatttagtgtaacctgtattacaagtacattgatgaattctgtatcttctttggtttcctgtatctttttaatcaagtctagaaactatgttcatcagtcactcatttttaaggtcgggagttagattttatgatagaattatgactgttagcttttctccttatagcatcttagtcttagaaattggtgggttgtaataatcaagggcttcattccttttatgtcatttctagacagttttgaatctaggttaataacactttatttataaagcacctcaatgtcctgtgaacactaattattttaaatgtgttaatactgtgcctttgatttgttagctttaaagttagtttaagacttttacactgccagtattccacatttggtgaaattaatacttttttaaagggtccaaataaaataattttctaatgtgtatatctgaaatttgtaataaaatcaacttcatattttaaaaattccaactatctgcttgcattggtgaatatatggcagtcgagagttataattttgggtatacttgtggttagttttgtgccataggaaaaaattatcttaaaactttggccatagttaataacattaacacttcaatagcaatcacatcttatatcctaaatgtcagaagatattctgaactggatgcctgaatagttaactaaaccagtcttgttagatgatggtactcttggcataaagcgaggattctgatatttggcatacttgtaaaaacaaatacataagtaaccattgaacattaatttgataataggtctagagactctaaaaactaaccaaacttggtgagtgtattcttatattaagaatatcttagtcatctcaaaactagcaaaatttaaattttggcatgttttccattcatatgttctttgcattttatttttgaggtttctgtgagaagtaaagatagttggaatttttgcgatattgaatagaacatcttctgttcccaacactgtttggcttcactaatttagaagtcaggaagcaatagaaagttggagatgaggaagtgctagagtaggtgtttgttttggttcttggagggaaaagattctttattccaatttccagagagaagagaaaactcacccaggaagtttaaaaattctttaaacaggtattttgatattggagaataacatgcatataattctgtaggaatgcacatgtaatccaagtgagtggagagtgtttttaatgtttttgaatgaaggaaatgaggttttgtttcacctgttttgcagcagtaagagaaactagtgctgcaagaatgtattttttaatgaagttccttattttgtcttgcatgttttagttttgcttatttttaaatttggaggtcctccataatgtcagataatattgacctgccatacgttagcactcttagttccgctactgtctttaacaggagcaaagagctgtgataaaccatgcttttttgagcttgtctgactcctaattaataacatgtttttggcaagacaacagattgaggttagaggatcagtaggacatttttattccatctgtcctatggggaaatttacaaatcccgtgctctaaaatgttctcaaacatttatatagatttccctttcatcttactaaattttgcattgttcttttcaagtatgtttcgtatttactgtctttttttctgccatttcccaaataataactccagatttcataattccagtttttacattccgttatctttctggtacaaccattcccattcagccttaaatctgagtcctttttagcagcaacttttttcctgggatcctccttcgtggtcttctaagtcagtgttagttttgaaatttttggccctgcataagttctgcatagcatctaatgtcaaaatagaaccaactggtaatcacagtattatttagtgtggtttccatgacaacaaaaatacatacgaagaaaacttctcaggttactatgctgaaattccaaaatgtctgagttttgaatagtgatcactttgttctggtattgacgcaattatattaggaaaaaagttggttgactgtttttgtttaattgacttctaaaatgttcaaattgtctagttctaaaagtttactaaatgcctagtgcagttaaacatactcttgtttaagtgtgtgttgctaaattttttactgtcattactaaataatctgtgtggcaaaatgtgtgtcagcacttttccctccttttttatctcctattttcaggagtcaaatgtagccataaactgtatccttgtctgacactttagctaaaaatttccagttaggggagtttattgccaaattaaatttggctgttccccccaacccatatagatattaaggaaggtgtacttaaaaaatgtttggactgcttttaaaacctgagcaatgtcattaatccatatgtggactagtgatgaatagatattttcataagagtttaaatgctgatatttggtggaagtagagagtaactcatattctatcaattcaagtattcttactatggttgctttccctatttgttcaatagactgataatactggaatttatagagtttgagccattacaacttttgtgaggatgtgtttcaaacatttctggacaaatcttattttgtatttctggaagaatgtagtaatcttctagaccgcttaaaaccaatgctcccaagctgaatattcttgagaaatttgtttttattatgccatttgacatttcaaatcagtgctcatatacagtaaacttgtgatagaaattgtattttattgctttttggattataattcatataaatataattacttgaatattgtttgagatcattaacatgccagggcagttcccactgatttagatggtccaagataatctcattcaggaggcttgaaacattaatggtttagtcttgtgaattttaacagttctctgtcatcgtttaacaaaaccaacaactgacacaactccttaagctgtggtttcagtctctgctagttcatattgcatgtttattttggacagtcttttgttaagcatggtgcttgtactggtttaaataaaatgttaacattaaaaaaaaacaaaaaaacacaaaacaaacaaaaaccccgggggcaccttatttccggggcggcgaaaaaaggcgtatagaaattggaccatgtgccaaagcgtttcctcggaccccgttttctcgtctcccagggtgaaaaatgccacggacccccaaataggaaccggaaaaatctcataacccggtcctgatatacacaaaaaaaccaacagatacga

SEQ ID NO: 454680 - DNA, 4208 bp, Homo sapiens
tggggaggccccacgccaggtccttctggttggagggcttcagcttctgagctttctgatgacattgcacattattatgtgtgtggtttttgagacattcattagccaaagagaaagttaaaatataccttacatatatgagatgaacaaatttgtaggattaagcaatgtagatccaaagagtgagtctttggttgtttgtgatgttgccgaagatttagtggaaaagctgagaaagtttcgttttcgcaaagaaacgaacaacgctgctattataatgaagattgacaaggataaacgcctggtggtactggatgaggagcttgagggcatttcaccagatgaacttaaagatgaactacctgaacgacaacctcgcttcattgtgtatagttataaatatcaacatgatgatggaagagtttcatatcctctgtgctttattttctccagtcctgttggatgtaagcctgaacaacagatgatgtatgctggaagtaagaataagctagtccagacagctgaactaaccaaggtatttgaaataagaaataccgaagacctaactgaagaatggttacgtgagaaacttggattttttcactaatgtgaacttctgtgtttctaaagtatttatgtattaacctgaccatactggaatcagacataaatacttatttatgcctaaaaatgcactgttacttacagtttgtttcctgcagtaaagaaaaattcttcatttgtgcaaaatttgaacaaagaggaaatcatcttcatagtaatgaaactttgtaaagtgtttccttatattggtaattgttaggtggactacttttctccagggactttttgcactcttgtgactaatttctataacttatggttcggaatttgttactatttacagacaccattggaaagtggatatattagattgtgagagacaacagttgcctccttttgacaaatactggatattagcagtttatttatgaaaatagcgtattatcacttgtcaaatcattgaaattcatttggggtcaaagacttgagtgacccagtattgagccatgaataatttagtgtaacctgtattacaagtacattgatgaattctgtatcttctttggtttcctgtatctttttaatcaagtctagaaactatgttcatcagtcactcatttttaaggtcgggagttagattttatgatagaattatgactgttagcttttctccttatagcatcttagtcttagaaattggtgggttgtaataatcaagggcttcattccttttatgtcatttctagacagttttgaatctaggttaataacactttatttataaagcacctcaatgtcctgtgaacactaattattttaaatgtgttaatactgtgcctttgatttgttagctttaaagttagtttaagacttttacactgccagtattccacatttggtgaaattaatacttttttaaagggtccaaataaaataattttctaatgtgtatatctgaaatttgtaataaaatcaacttcatattttaaaaattccaactatctgcttgcattggtgaatatatggcagtcgagagttataattttgggtatacttgtggttagttttgtgccataggaaaaaattatcttaaaactttggccatagttaataacattaacacttcaatagcaatcacatcttatatcctaaatgtcagaagatattctgaactggatgcctgaatagttaactaaaccagtcttgttagatgatggtactcttggcataaagcgaggattctgatatttggcatacttgtaaaaacaaatacataagtaaccattgaacattaatttgataataggtctagagactctaaaaactaaccaaacttggtgagtgtattcttatattaagaatatcttagtcatctcaaaactagcaaaatttaaattttggcatgttttccattcatatgttctttgcattttatttttgaggtttctgtgagaagtaaagatagttggaatttttgcgatattgaatagaacatcttctgttcccaacactgtttggcttcactaatttagaagtcaggaagcaatagaaagttggagatgaggaagtgctagagtaggtgtttgttttggttcttggagggaaaagattctttattccaatttccagagagaagagaaaactcacccaggaagtttaaaaattctttaaacaggtattttgatattggagaataacatgcatataattctgtaggaatgcacatgtaatccaagtgagtggagagtgtttttaatgtttttgaatgaaggaaatgaggttttgtttcacctgttttgcagcagtaagagaaactagtgctgcaagaatgtattttttaatgaagttccttattttgtcttgcatgttttagttttgcttatttttaaatttggaggtcctccataatgtcagataatattgacctgccatacgttagcactcttagttccgctactgtctttaacaggagcaaagagctgtgataaaccatgcttttttgagcttgtctgactcctaattaataacatgtttttggcaagacaacagattgaggttagaggatcagtaggacatttttattccatctgtcctatggggaaatttacaaatcccgtgctctaaaatgttctcaaacatttatatagatttccctttcatcttactaaattttgcattgttcttttcaagtatgtttcgtatttactgtctttttttctgccatttcccaaataataactccagatttcataattccagtttttacattccgttatctttctggtacaaccattcccattcagccttaaatctgagtcctttttagcagcaacttttttcctgggatcctccttcgtggtcttctaagtcagtgttagttttgaaatttttggccctgcataagttctgcatagcatctaatgtcaaaatagaaccaactggtaatcacagtattatttagtgtggtttccatgacaacaaaaatacatacgaagaaaacttctcaggttactatgctgaaattccaaaatgtctgagttttgaatagtgatcactttgttctggtattgacgcaattatattaggaaaaaagttggttgactgtttttgtttaattgacttctaaaatgttcaaattgtctagttctaaaagtttactaaatgcctagtgcagttaaacatactcttgtttaagtgtgtgttgctaaattttttactgtcattactaaataatctgtgtggcaaaatgtgtgtcagcacttttccctccttttttatctcctattttcaggagtcaaatgtagccataaactgtatccttgtctgacactttagctaaaaatttccagttaggggagtttattgccaaattaaatttggctgttccccccaacccatatagatattaaggaaggtgtacttaaaaaatgtttggactgcttttaaaacctgagcaatgtcattaatccatatgtggactagtgatgaatagatattttcataagagtttaaatgctgatatttggtggaagtagagagtaactcatattctatcaattcaagtattcttactatggttgctttccctatttgttcaatagactgataatactggaatttatagagtttgagccattacaacttttgtgaggatgtgtttcaaacatttctggacaaatcttattttgtatttctggaagaatgtagtaatcttctagaccgcttaaaaccaatgctcccaagctgaatattcttgagaaatttgtttttattatgccatttgacatttcaaatcagtgctcatatacagtaaacttgtgatagaaattgtattttattgctttttggattataattcatataaatataattacttgaatattgtttgagatcattaacatgccagggcagttcccactgatttagatggtccaagataatctcattcaggaggcttgaaacattaatggtttagtcttgtgaattttaacagttctctgtcatcgtttaacaaaaccaacaactgacacaactccttaagctgtggtttcagtctctgctagttcatattgcatgtttattttggacagtcttttgttaagcatggtgcttgtactggtttaaataaaatgttaacattaaaa

SEQ ID NO: 454681 - DNA, 4223 bp, Homo sapiens
tgataggtgggggcgactgggccaggcgccggggcaggaagggaggcggccgccgtgccattcttaaaggcgcccgagtgtaggcgacaggccgctgacggccggaaggaaaatgagtgagtctttggttgtttgtgatgttgccgaagatttagtggaaaagctgagaaagtttcgttttcgcaaagaaacgaacaacgctgctattataatgaagattgacaaggataaacgcctggtggtactggatgaggagcttgagggcatttcaccagatgaacttaaagatgaactacctgaacgacaacctcgatccttttcttagtgctttaaaagatttattttctttagtggtcagacctgtttgtgagctcatttgttaaacatctaaaacttcattgtgtatagttataaatatcaacatgatgatggaagagtttcatatcctctgtgctttattttctccagtcctgttggatgtaagcctgaacaacagatgatgtatgctggaagtaagaataagctagtccagacagctgaactaaccaaggtatttgaaataagaaataccgaagacctaactgaagaatggttacgtgagaaacttggattttttcactaatgtgaacttctgtgtttctaaagtatttatgtattaacctgaccatactggaatcagacataaatacttatttatgcctaaaaatgcactgttacttacagtttgtttcctgcagtaaagaaaaattcttcatttgtgcaaaatttgaacaaagaggaaatcatcttcatagtaatgaaactttgtaaagtgtttccttatattggtaattgttaggtggactacttttctccagggactttttgcactcttgtgactaatttctataacttatggttcggaatttgttactatttacagacaccattggaaagtggatatattagattgtgagagacaacagttgcctccttttgacaaatactggatattagcagtttatttatgaaaatagcgtattatcacttgtcaaatcattgaaattcatttggggtcaaagacttgagtgacccagtattgagccatgaataatttagtgtaacctgtattacaagtacattgatgaattctgtatcttctttggtttcctgtatctttttaatcaagtctagaaactatgttcatcagtcactcatttttaaggtcgggagttagattttatgatagaattatgactgttagcttttctccttatagcatcttagtcttagaaattggtgggttgtaataatcaagggcttcattccttttatgtcatttctagacagttttgaatctaggttaataacactttatttataaagcacctcaatgtcctgtgaacactaattattttaaatgtgttaatactgtgcctttgatttgttagctttaaagttagtttaagacttttacactgccagtattccacatttggtgaaattaatacttttttaaagggtccaaataaaataattttctaatgtgtatatctgaaatttgtaataaaatcaacttcatattttaaaaattccaactatctgcttgcattggtgaatatatggcagtcgagagttataattttgggtatacttgtggttagttttgtgccataggaaaaaattatcttaaaactttggccatagttaataacattaacacttcaatagcaatcacatcttatatcctaaatgtcagaagatattctgaactggatgcctgaatagttaactaaaccagtcttgttagatgatggtactcttggcataaagcgaggattctgatatttggcatacttgtaaaaacaaatacataagtaaccattgaacattaatttgataataggtctagagactctaaaaactaaccaaacttggtgagtgtattcttatattaagaatatcttagtcatctcaaaactagcaaaatttaaattttggcatgttttccattcatatgttctttgcattttatttttgaggtttctgtgagaagtaaagatagttggaatttttgcgatattgaatagaacatcttctgttcccaacactgtttggcttcactaatttagaagtcaggaagcaatagaaagttggagatgaggaagtgctagagtaggtgtttgttttggttcttggagggaaaagattctttattccaatttccagagagaagagaaaactcacccaggaagtttaaaaattctttaaacaggtattttgatattggagaataacatgcatataattctgtaggaatgcacatgtaatccaagtgagtggagagtgtttttaatgtttttgaatgaaggaaatgaggttttgtttcacctgttttgcagcagtaagagaaactagtgctgcaagaatgtattttttaatgaagttccttattttgtcttgcatgttttagttttgcttatttttaaatttggaggtcctccataatgtcagataatattgacctgccatacgttagcactcttagttccgctactgtctttaacaggagcaaagagctgtgataaaccatgcttttttgagcttgtctgactcctaattaataacatgtttttggcaagacaacagattgaggttagaggatcagtaggacatttttattccatctgtcctatggggaaatttacaaatcccgtgctctaaaatgttctcaaacatttatatagatttccctttcatcttactaaattttgcattgttcttttcaagtatgtttcgtatttactgtctttttttctgccatttcccaaataataactccagatttcataattccagtttttacattccgttatctttctggtacaaccattcccattcagccttaaatctgagtcctttttagcagcaacttttttcctgggatcctccttcgtggtcttctaagtcagtgttagttttgaaatttttggccctgcataagttctgcatagcatctaatgtcaaaatagaaccaactggtaatcacagtattatttagtgtggtttccatgacaacaaaaatacatacgaagaaaacttctcaggttactatgctgaaattccaaaatgtctgagttttgaatagtgatcactttgttctggtattgacgcaattatattaggaaaaaagttggttgactgtttttgtttaattgacttctaaaatgttcaaattgtctagttctaaaagtttactaaatgcctagtgcagttaaacatactcttgtttaagtgtgtgttgctaaattttttactgtcattactaaataatctgtgtggcaaaatgtgtgtcagcacttttccctccttttttatctcctattttcaggagtcaaatgtagccataaactgtatccttgtctgacactttagctaaaaatttccagttaggggagtttattgccaaattaaatttggctgttccccccaacccatatagatattaaggaaggtgtacttaaaaaatgtttggactgcttttaaaacctgagcaatgtcattaatccatatgtggactagtgatgaatagatattttcataagagtttaaatgctgatatttggtggaagtagagagtaactcatattctatcaattcaagtattcttactatggttgctttccctatttgttcaatagactgataatactggaatttatagagtttgagccattacaacttttgtgaggatgtgtttcaaacatttctggacaaatcttattttgtatttctggaagaatgtagtaatcttctagaccgcttaaaaccaatgctcccaagctgaatattcttgagaaatttgtttttattatgccatttgacatttcaaatcagtgctcatatacagtaaacttgtgatagaaattgtattttattgctttttggattataattcatataaatataattacttgaatattgtttgagatcattaacatgccagggcagttcccactgatttagatggtccaagataatctcattcaggaggcttgaaacattaatggtttagtcttgtgaattttaacagttctctgtcatcgtttaacaaaaccaacaactgacacaactccttaagctgtggtttcagtctctgctagttcatattgcatgtttattttggacagtcttttgttaagcatggtgcttgtactggtttaaataaaatgttaacattaaaa

SEQ ID NO: 454682 - DNA, 4116 bp, Homo sapiens
tgataggtgggggcgactgggccaggcgccggggcaggaagggaggcggccgccgtgccattcttaaaggcgcccgagtgtaggcgacaggccgctgacggccggaaggaaaatgagtgagtctttggttgtttgtgatgttgccgaagatttagtggaaaagctgagaaagtttcgttttcgcaaagaaacgaacaacgctgctattataatgaagattgacaaggataaacgcctggtggtactggatgaggagcttgagggcatttcaccagatgaacttaaagatgaactacctgaacgacaacctcgaacatgatgatggaagagtttcatatcctctgtgctttattttctccagtcctgttggatgtaagcctgaacaacagatgatgtatgctggaagtaagaataagctagtccagacagctgaactaaccaaggtatttgaaataagaaataccgaagacctaactgaagaatggttacgtgagaaacttggattttttcactaatgtgaacttctgtgtttctaaagtatttatgtattaacctgaccatactggaatcagacataaatacttatttatgcctaaaaatgcactgttacttacagtttgtttcctgcagtaaagaaaaattcttcatttgtgcaaaatttgaacaaagaggaaatcatcttcatagtaatgaaactttgtaaagtgtttccttatattggtaattgttaggtggactacttttctccagggactttttgcactcttgtgactaatttctataacttatggttcggaatttgttactatttacagacaccattggaaagtggatatattagattgtgagagacaacagttgcctccttttgacaaatactggatattagcagtttatttatgaaaatagcgtattatcacttgtcaaatcattgaaattcatttggggtcaaagacttgagtgacccagtattgagccatgaataatttagtgtaacctgtattacaagtacattgatgaattctgtatcttctttggtttcctgtatctttttaatcaagtctagaaactatgttcatcagtcactcatttttaaggtcgggagttagattttatgatagaattatgactgttagcttttctccttatagcatcttagtcttagaaattggtgggttgtaataatcaagggcttcattccttttatgtcatttctagacagttttgaatctaggttaataacactttatttataaagcacctcaatgtcctgtgaacactaattattttaaatgtgttaatactgtgcctttgatttgttagctttaaagttagtttaagacttttacactgccagtattccacatttggtgaaattaatacttttttaaagggtccaaataaaataattttctaatgtgtatatctgaaatttgtaataaaatcaacttcatattttaaaaattccaactatctgcttgcattggtgaatatatggcagtcgagagttataattttgggtatacttgtggttagttttgtgccataggaaaaaattatcttaaaactttggccatagttaataacattaacacttcaatagcaatcacatcttatatcctaaatgtcagaagatattctgaactggatgcctgaatagttaactaaaccagtcttgttagatgatggtactcttggcataaagcgaggattctgatatttggcatacttgtaaaaacaaatacataagtaaccattgaacattaatttgataataggtctagagactctaaaaactaaccaaacttggtgagtgtattcttatattaagaatatcttagtcatctcaaaactagcaaaatttaaattttggcatgttttccattcatatgttctttgcattttatttttgaggtttctgtgagaagtaaagatagttggaatttttgcgatattgaatagaacatcttctgttcccaacactgtttggcttcactaatttagaagtcaggaagcaatagaaagttggagatgaggaagtgctagagtaggtgtttgttttggttcttggagggaaaagattctttattccaatttccagagagaagagaaaactcacccaggaagtttaaaaattctttaaacaggtattttgatattggagaataacatgcatataattctgtaggaatgcacatgtaatccaagtgagtggagagtgtttttaatgtttttgaatgaaggaaatgaggttttgtttcacctgttttgcagcagtaagagaaactagtgctgcaagaatgtattttttaatgaagttccttattttgtcttgcatgttttagttttgcttatttttaaatttggaggtcctccataatgtcagataatattgacctgccatacgttagcactcttagttccgctactgtctttaacaggagcaaagagctgtgataaaccatgcttttttgagcttgtctgactcctaattaataacatgtttttggcaagacaacagattgaggttagaggatcagtaggacatttttattccatctgtcctatggggaaatttacaaatcccgtgctctaaaatgttctcaaacatttatatagatttccctttcatcttactaaattttgcattgttcttttcaagtatgtttcgtatttactgtctttttttctgccatttcccaaataataactccagatttcataattccagtttttacattccgttatctttctggtacaaccattcccattcagccttaaatctgagtcctttttagcagcaacttttttcctgggatcctccttcgtggtcttctaagtcagtgttagttttgaaatttttggccctgcataagttctgcatagcatctaatgtcaaaatagaaccaactggtaatcacagtattatttagtgtggtttccatgacaacaaaaatacatacgaagaaaacttctcaggttactatgctgaaattccaaaatgtctgagttttgaatagtgatcactttgttctggtattgacgcaattatattaggaaaaaagttggttgactgtttttgtttaattgacttctaaaatgttcaaattgtctagttctaaaagtttactaaatgcctagtgcagttaaacatactcttgtttaagtgtgtgttgctaaattttttactgtcattactaaataatctgtgtggcaaaatgtgtgtcagcacttttccctccttttttatctcctattttcaggagtcaaatgtagccataaactgtatccttgtctgacactttagctaaaaatttccagttaggggagtttattgccaaattaaatttggctgttccccccaacccatatagatattaaggaaggtgtacttaaaaaatgtttggactgcttttaaaacctgagcaatgtcattaatccatatgtggactagtgatgaatagatattttcataagagtttaaatgctgatatttggtggaagtagagagtaactcatattctatcaattcaagtattcttactatggttgctttccctatttgttcaatagactgataatactggaatttatagagtttgagccattacaacttttgtgaggatgtgtttcaaacatttctggacaaatcttattttgtatttctggaagaatgtagtaatcttctagaccgcttaaaaccaatgctcccaagctgaatattcttgagaaatttgtttttattatgccatttgacatttcaaatcagtgctcatatacagtaaacttgtgatagaaattgtattttattgctttttggattataattcatataaatataattacttgaatattgtttgagatcattaacatgccagggcagttcccactgatttagatggtccaagataatctcattcaggaggcttgaaacattaatggtttagtcttgtgaattttaacagttctctgtcatcgtttaacaaaaccaacaactgacacaactccttaagctgtggtttcagtctctgctagttcatattgcatgtttattttggacagtcttttgttaagcatggtgcttgtactggtttaaataaaatgttaacattaaaa

SEQ ID NO: 454683 - DNA, 3241 bp, Homo sapiens
caatgtcctgtgaacactaattattttaaatgtgttaatactgtgcctttgatttgttagctttaaagttagtttaagacttttacactgccagtattgagccatgaataatttagtgtaacctgtattacaagtacattgatgaattctgtatcttctttggtttcctgtatctttttaatcaagtctagaaactatgttcatcagtcactcatttttaaggtcgggagttagattttatgatagaattatgactgttagcttttctccttatagcatcttagtcttagaaattggtgggttgtaataatcaagggcttcattccttttatgtcatttctagacagttttgaatctaggttaataacactttatttataaagcacctcaatgtcctgtgaacactaattattttaaatgtgttaatactgtgcctttgatttgttagctttaaagttagtttaagacttttacactgccagtattccacatttggtgaaattaatacttttttaaagggtccaaataaaataattttctaatgtgtatatctgaaatttgtaataaaatcaacttcatattttaaaaattccaactatctgcttgcattggtgaatatatggcagtcgagagttataattttgggtatacttgtggttagttttgtgccataggaaaaaattatcttaaaactttggccatagttaataacattaacacttcaatagcaatcacatcttatatcctaaatgtcagaagatattctgaactggatgcctgaatagttaactaaaccagtcttgttagatgatggtactcttggcataaagcgaggattctgatatttggcatacttgtaaaaacaaatacataagtaaccattgaacattaatttgataataggtctagagactctaaaaactaaccaaacttggtgagtgtattcttatattaagaatatcttagtcatctcaaaactagcaaaatttaaattttggcatgttttccattcatatgttctttgcattttatttttgaggtttctgtgagaagtaaagatagttggaatttttgcgatattgaatagaacatcttctgttcccaacactgtttggcttcactaatttagaagtcaggaagcaatagaaagttggagatgaggaagtgctagagtaggtgtttgttttggttcttggagggaaaagattctttattccaatttccagagagaagagaaaactcacccaggaagtttaaaaattctttaaacaggtattttgatattggagaataacatgcatataattctgtaggaatgcacatgtaatccaagtgagtggagagtgtttttaatgtttttgaatgaaggaaatgaggttttgtttcacctgttttgcagcagtaagagaaactagtgctgcaagaatgtattttttaatgaagttccttattttgtcttgcatgttttagttttgcttatttttaaatttggaggtcctccataatgtcagataatattgacctgccatacgttagcactcttagttccgctactgtctttaacaggagcaaagagctgtgataaaccatgcttttttgagcttgtctgactcctaattaataacatgtttttggcaagacaacagattgaggttagaggatcagtaggacatttttattccatctgtcctatggggaaatttacaaatcccgtgctctaaaatgttctcaaacatttatatagatttccctttcatcttactaaattttgcattgttcttttcaagtatgtttcgtatttactgtctttttttctgccatttcccaaataataactccagatttcataattccagtttttacattccgttatctttctggtacaaccattcccattcagccttaaatctgagtcctttttagcagcaacttttttcctgggatcctccttcgtggtcttctaagtcagtgttagttttgaaatttttggccctgcataagttctgcatagcatctaatgtcaaaatagaaccaactggtaatcacagtattatttagtgtggtttccatgacaacaaaaatacatacgaagaaaacttctcaggttactatgctgaaattccaaaatgtctgagttttgaatagtgatcactttgttctggtattgacgcaattatattaggaaaaaagttggttgactgtttttgtttaattgacttctaaaatgttcaaattgtctagttctaaaagtttactaaatgcctagtgcagttaaacatactcttgtttaagtgtgtgttgctaaattttttactgtcattactaaataatctgtgtggcaaaatgtgtgtcagcacttttccctccttttttatctcctattttcaggagtcaaatgtagccataaactgtatccttgtctgacactttagctaaaaatttccagttaggggagtttattgccaaattaaatttggctgttccccccaacccatatagatattaaggaaggtgtacttaaaaaatgtttggactgcttttaaaacctgagcaatgtcattaatccatatgtggactagtgatgaatagatattttcataagagtttaaatgctgatatttggtggaagtagagagtaactcatattctatcaattcaagtattcttactatggttgctttccctatttgttcaatagactgataatactggaatttatagagtttgagccattacaacttttgtgaggatgtgtttcaaacatttctggacaaatcttattttgtatttctggaagaatgtagtaatcttctagaccgcttaaaaccaatgctcccaagctgaatattcttgagaaatttgtttttattatgccatttgacatttcaaatcagtgctcatatacagtaaacttgtgatagaaattgtattttattgctttttggattataattcatataaatataattacttgaatattgtttgagatcattaacatgccagggcagttcccactgatttagatggtccaagataatctcattcaggaggcttgaaacattaatggtttagtcttgtgaattttaacagttctctgtcatcgtttaacaaaaccaacaactgacacaactccttaagctgtggtttcagtctctgctagttcatattgcatgtttattttggacagtcttttgttaagcatggtgcttgtactggtttaaataaaatgttaacattaaaa

SEQ ID NO: 454684 - DNA, 2029 bp, Homo sapiens
aaataaaatgcaaagaacatatgaatggaaaacatgccaaaatttaaattttgctagttttgagatgactaagatattcttaatataagaatacactcaccaagtttggttagtttttagagtctctagacctattatcaaattaatgttcaatggttacttatgttttgtttcacctgttttgcagcagtaagagaaactagtgctgcaagaatgtattttttaatgaagttccttattttgtcttgcatgttttagttttgcttatttttaaatttggaggtcctccataatgtcagataatattgacctgccatacgttagcactcttagttccgctactgtctttaacaggagcaaagagctgtgataaaccatgcttttttgagcttgtctgactcctaattaataacatgtttttggcaagacaacagattgaggttagaggatcagtaggacatttttattccatctgtcctatggggaaatttacaaatcccgtgctctaaaatgttctcaaacatttatatagatttccctttcatcttactaaattttgcattgttcttttcaagtatgtttcgtatttactgtctttttttctgccatttcccaaataataactccagatttcataattccagtttttacattccgttatctttctggtacaaccattcccattcagccttaaatctgagtcctttttagcagcaacttttttcctgggatcctccttcgtggtcttctaagtcagtgttagttttgaaatttttggccctgcataagttctgcatagcatctaatgtcaaaatagaaccaactggtaatcacagtattatttagtgtggtttccatgacaacaaaaatacatacgaagaaaacttctcaggttactatgctgaaattccaaaatgtctgagttttgaatagtgatcactttgttctggtattgacgcaattatattaggaaaaaagttggttgactgtttttgtttaattgacttctaaaatgttcaaattgtctagttctaaaagtttactaaatgcctagtgcagttaaacatactcttgtttaagtgtgtgttgctaaattttttactgtcattactaaataatctgtgtggcaaaatgtgtgtcagcacttttccctccttttttatctcctattttcaggagtcaaatgtagccataaactgtatccttgtctgacactttagctaaaaatttccagttaggggagtttattgccaaattaaatttggctgttccccccaacccatatagatattaaggaaggtgtacttaaaaaatgtttggactgcttttaaaacctgagcaatgtcattaatccatatgtggactagtgatgaatagatattttcataagagtttaaatgctgatatttggtggaagtagagagtaactcatattctatcaattcaagtattcttactatggttgctttccctatttgttcaatagactgataatactggaatttatagagtttgagccattacaacttttgtgaggatgtgtttcaaacatttctggacaaatcttattttgtatttctggaagaatgtagtaatcttctagaccgcttaaaaccaatgctcccaagctgaatattcttgagaaatttgtttttattatgccatttgacatttcaaatcagtgctcatatacagtaaacttgtgatagaaattgtattttattgctttttggattataattcatataaatataattacttgaatattgtttgagatcattaacatgccagggcagttcccactgatttagatggtccaagataatctcattcaggaggcttgaaacattaatggtttagtcttgtgaattttaacagttctctgtcatcgtttaacaaaaccaacaactgacacaactccttaagctgtggtttcagtctctgctagttcatattgcatgtttattttggacagtcttttgttaagcatggtgcttgtactggtttaaataaaatgttaacattaaaa

SEQ ID NO: 454685 - DNA, 816 bp, Homo sapiens
tgataggtgggggcgactgggccaggcgccggggcaggaagggaggcggccgccgtgccattcttaaaggcgcccgagtgtaggcgacaggccgctgacggccggaaggaaaatgagtgagtctttggttgtttgtgatgttgccgaagatttagtggaaaagctgagaaagtttcgttttcgcaaagaaacgaacaacgctgctattataatgaagattgacaaggataaacgcctggtggtactggatgaggagcttgagggcatttcaccagatgaacttaaagatgaactacctgaacgacaacctcgcttcattgtgtatagttataaatatcaacatgatgatggaagagtttcatatcctctgtgctttattttctccagtcctgttggatgtaagcctgaacaacagatgatgtatgctggaagtaagaataagctagtccagacagctgaactaaccaaggtatttgaaataagaaataccgaagacctaactgaagaatggttacgtgagaaacttggattttttcactaatgtgaacttctgtgtttctaaagtatttatgtattaacctgaccatactggaatcagacataaatacttatttatgcctaaaaatgcactgttacttacagtttgtttcctgcagtaaagaaaaattcttcatttgtgcaaaatttgaacaaagaggaaatcatcttcatagtaatgaaactttgtaaagtgtttccttatattggtaattgttagtctaccagaacaactcgctacagttagtctacctgtaagctccggtgagcacctcagca

SEQ ID NO: 454686 - DNA, 234 bp, Homo sapiens
gtaagtgaatttctttaaataacacatatttggcttagatccaattaagccattttatactagacaaattttctgctgtttttaaagatgaacattgttgaataacctaaattgaggagggtctgtgtctatgtgtgtccatgtgcctgtgtgcatgcatccctagaaagaatgaagcatcatctcttagaacttattttcttaggataaatttctagacgtgtaattgttgac

SEQ ID NO: 454687 - DNA, 4088 bp, Homo sapiens
tgataggtgggggcgactgggccaggcgccggggcaggaagggaggcggccgccgtgccattcttaaaggcgcccgagtgtaggcgacaggccgctgacggccggaaggaaaatgagtgagtctttggttgtttgtgatgttgccgaagatttagtggaaaagctgagaaagtttcgttttcgcaaagaaacgaacaacgctgctattataatgaagattgacaaggataaacgcctggtggtactggatgaggagcttgagggcatttcaccagatgaacttaaagatgaactacctgaacgacaacctcgcttcattgtgtatagttataaatatcaacatgatgatggaagagtttcatatcctctgtgctttattttctccagtcctgttggatgtaagcctgaacaacagatgatgtatgctggaagtaagaataagctagtccagacagctgaactaaccaaggtatttgaaataagaaataccgaagacctaactgaagaatggttacgtgagaaacttggattttttcactaatgtgaacttctgtgtttctaaagtatttatgtattaacctgaccatactggaatcagacataaatacttatttatgcctaaaaatgcactgttacttacagtttgtttcctgcagtaaagaaaaattcttcatttgtgcaaaatttgaacaaagaggaaatcatcttcatagtaatgaaactttgtaaagtgtttccttatattggtaattgttaggtggactacttttctccagggactttttgcactcttgtgactaatttctataacttatggttcggaatttgttactatttacagacaccattggaaagtggatatattagattgtgagagacaacagttgcctccttttgacaaatactggatattagcagtttatttatgaaaatagcgtattatcacttgtcaaatcattgaaattcatttggggtcaaagacttgagtgacccagtattgagccatgaataatttagtgtaacctgtattacaagtacattgatgaattctgtatcttctttggtttcctgtatctttttaatcaagtctagaaactatgttcatcagtcactcatttttaaggtcgggagttagattttatgatagaattatgactgttagcttttctccttatagcatcttagtcttagaaattggtgggttgtaataatcaagggcttcattccttttatgtcatttctagacagttttgaatctaggttaataacactttatttataaagcacctcaatgtcctgtgaacactaattattttaaatgtgttaatactgtgcctttgatttgttagctttaaagttagtttaagacttttacactgccagtattccacatttggtgaaattaatacttttttaaagggtccaaataaaataattttctaatgtgtatatctgaaatttgtaataaaatcaacttcatattttaaaaattccaactatctgcttgcattggtgaatatatggcagtcgagagttataattttgggtatacttgtggttagttttgtgccataggaaaaaattatcttaaaactttggccatagttaataacattaacacttcaatagcaatcacatcttatatcctaaatgtcagaagatattctgaactggatgcctgaatagttaactaaaccagtcttgttagatgatggtactcttggcataaagcgaggattctgatatttggcatacttgtaaaaacaaatacataagtaaccattgaacattaatttgataataggtctagagactctaaaaactaaccaaacttggtgagtgtattcttatattaagaatatcttagtcatctcaaaactagcgaggtttctgtgagaagtaaagatagttggaatttttgcgatattgaatagaacatcttctgttcccaacactgtttggcttcactaatttagaagtcaggaagcaatagaaagttggagatgaggaagtgctagagtaggtgtttgttttggttcttggagggaaaagattctttattccaatttccagagagaagagaaaactcacccaggaagtttaaaaattctttaaacaggtattttgatattggagaataacatgcatataattctgtaggaatgcacatgtaatccaagtgagtggagagtgtttttaatgtttttgaatgaaggaaatgaggttttgtttcacctgttttgcagcagtaagagaaactagtgctgcaagaatgtattttttaatgaagttccttattttgtcttgcatgttttagttttgcttatttttaaatttggaggtcctccataatgtcagataatattgacctgccatacgttagcactcttagttccgctactgtctttaacaggagcaaagagctgtgataaaccatgcttttttgagcttgtctgactcctaattaataacatgtttttggcaagacaacagattgaggttagaggatcagtaggacatttttattccatctgtcctatggggaaatttacaaatcccgtgctctaaaatgttctcaaacatttatatagatttccctttcatcttactaaattttgcattgttcttttcaagtatgtttcgtatttactgtctttttttctgccatttcccaaataataactccagatttcataattccagtttttacattccgttatctttctggtacaaccattcccattcagccttaaatctgagtcctttttagcagcaacttttttcctgggatcctccttcgtggtcttctaagtcagtgttagttttgaaatttttggccctgcataagttctgcatagcatctaatgtcaaaatagaaccaactggtaatcacagtattatttagtgtggtttccatgacaacaaaaatacatacgaagaaaacttctcaggttactatgctgaaattccaaaatgtctgagttttgaatagtgatcactttgttctggtattgacgcaattatattaggaaaaaagttggttgactgtttttgtttaattgacttctaaaatgttcaaattgtctagttctaaaagtttactaaatgcctagtgcagttaaacatactcttgtttaagtgtgtgttgctaaattttttactgtcattactaaataatctgtgtggcaaaatgtgtgtcagcacttttccctccttttttatctcctattttcaggagtcaaatgtagccataaactgtatccttgtctgacactttagctaaaaatttccagttaggggagtttattgccaaattaaatttggctgttccccccaacccatatagatattaaggaaggtgtacttaaaaaatgtttggactgcttttaaaacctgagcaatgtcattaatccatatgtggactagtgatgaatagatattttcataagagtttaaatgctgatatttggtggaagtagagagtaactcatattctatcaattcaagtattcttactatggttgctttccctatttgttcaatagactgataatactggaatttatagagtttgagccattacaacttttgtgaggatgtgtttcaaacatttctggacaaatcttattttgtatttctggaagaatgtagtaatcttctagaccgcttaaaaccaatgctcccaagctgaatattcttgagaaatttgtttttattatgccatttgacatttcaaatcagtgctcatatacagtaaacttgtgatagaaattgtattttattgctttttggattataattcatataaatataattacttgaatattgtttgagatcattaacatgccagggcagttcccactgatttagatggtccaagataatctcattcaggaggcttgaaacattaatggtttagtcttgtgaattttaacagttctctgtcatcgtttaacaaaaccaacaactgacacaactccttaagctgtggtttcagtctctgctagttcatattgcatgtttattttggacagtcttttgttaagcatggtgcttgtactggtttaaataaaatgttaacattaaaa

SEQ ID NO: 454688 - DNA, 4198 bp, Homo sapiens
agccggcggcggcgggcagcgcccaggagggctcggcggccgcttccgctcccagcagctggccagtgcccatagctagagtacttggcctctgccgccgccaccacgcctcagggcagcatcttccagctgggcccggggtggacccgcccagcgggccatgggactaggagtgagtctttggttgtttgtgatgttgccgaagatttagtggaaaagctgagaaagtttcgttttcgcaaagaaacgaacaacgctgctattataatgaagattgacaaggataaacgcctggtggtactggatgaggagcttgagggcatttcaccagatgaacttaaagatgaactacctgaacgacaacctcgcttcattgtgtatagttataaatatcaacatgatgatggaagagtttcatatcctctgtgctttattttctccagtcctgttggatgtaagcctgaacaacagatgatgtatgctggaagtaagaataagctagtccagacagctgaactaaccaaggtatttgaaataagaaataccgaagacctaactgaagaatggttacgtgagaaacttggattttttcactaatgtgaacttctgtgtttctaaagtatttatgtattaacctgaccatactggaatcagacataaatacttatttatgcctaaaaatgcactgttacttacagtttgtttcctgcagtaaagaaaaattcttcatttgtgcaaaatttgaacaaagaggaaatcatcttcatagtaatgaaactttgtaaagtgtttccttatattggtaattgttaggtggactacttttctccagggactttttgcactcttgtgactaatttctataacttatggttcggaatttgttactatttacagacaccattggaaagtggatatattagattgtgagagacaacagttgcctccttttgacaaatactggatattagcagtttatttatgaaaatagcgtattatcacttgtcaaatcattgaaattcatttggggtcaaagacttgagtgacccagtattgagccatgaataatttagtgtaacctgtattacaagtacattgatgaattctgtatcttctttggtttcctgtatctttttaatcaagtctagaaactatgttcatcagtcactcatttttaaggtcgggagttagattttatgatagaattatgactgttagcttttctccttatagcatcttagtcttagaaattggtgggttgtaataatcaagggcttcattccttttatgtcatttctagacagttttgaatctaggttaataacactttatttataaagcacctcaatgtcctgtgaacactaattattttaaatgtgttaatactgtgcctttgatttgttagctttaaagttagtttaagacttttacactgccagtattccacatttggtgaaattaatacttttttaaagggtccaaataaaataattttctaatgtgtatatctgaaatttgtaataaaatcaacttcatattttaaaaattccaactatctgcttgcattggtgaatatatggcagtcgagagttataattttgggtatacttgtggttagttttgtgccataggaaaaaattatcttaaaactttggccatagttaataacattaacacttcaatagcaatcacatcttatatcctaaatgtcagaagatattctgaactggatgcctgaatagttaactaaaccagtcttgttagatgatggtactcttggcataaagcgaggattctgatatttggcatacttgtaaaaacaaatacataagtaaccattgaacattaatttgataataggtctagagactctaaaaactaaccaaacttggtgagtgtattcttatattaagaatatcttagtcatctcaaaactagcaaaatttaaattttggcatgttttccattcatatgttctttgcattttatttttgaggtttctgtgagaagtaaagatagttggaatttttgcgatattgaatagaacatcttctgttcccaacactgtttggcttcactaatttagaagtcaggaagcaatagaaagttggagatgaggaagtgctagagtaggtgtttgttttggttcttggagggaaaagattctttattccaatttccagagagaagagaaaactcacccaggaagtttaaaaattctttaaacaggtattttgatattggagaataacatgcatataattctgtaggaatgcacatgtaatccaagtgagtggagagtgtttttaatgtttttgaatgaaggaaatgaggttttgtttcacctgttttgcagcagtaagagaaactagtgctgcaagaatgtattttttaatgaagttccttattttgtcttgcatgttttagttttgcttatttttaaatttggaggtcctccataatgtcagataatattgacctgccatacgttagcactcttagttccgctactgtctttaacaggagcaaagagctgtgataaaccatgcttttttgagcttgtctgactcctaattaataacatgtttttggcaagacaacagattgaggttagaggatcagtaggacatttttattccatctgtcctatggggaaatttacaaatcccgtgctctaaaatgttctcaaacatttatatagatttccctttcatcttactaaattttgcattgttcttttcaagtatgtttcgtatttactgtctttttttctgccatttcccaaataataactccagatttcataattccagtttttacattccgttatctttctggtacaaccattcccattcagccttaaatctgagtcctttttagcagcaacttttttcctgggatcctccttcgtggtcttctaagtcagtgttagttttgaaatttttggccctgcataagttctgcatagcatctaatgtcaaaatagaaccaactggtaatcacagtattatttagtgtggtttccatgacaacaaaaatacatacgaagaaaacttctcaggttactatgctgaaattccaaaatgtctgagttttgaatagtgatcactttgttctggtattgacgcaattatattaggaaaaaagttggttgactgtttttgtttaattgacttctaaaatgttcaaattgtctagttctaaaagtttactaaatgcctagtgcagttaaacatactcttgtttaagtgtgtgttgctaaattttttactgtcattactaaataatctgtgtggcaaaatgtgtgtcagcacttttccctccttttttatctcctattttcaggagtcaaatgtagccataaactgtatccttgtctgacactttagctaaaaatttccagttaggggagtttattgccaaattaaatttggctgttccccccaacccatatagatattaaggaaggtgtacttaaaaaatgtttggactgcttttaaaacctgagcaatgtcattaatccatatgtggactagtgatgaatagatattttcataagagtttaaatgctgatatttggtggaagtagagagtaactcatattctatcaattcaagtattcttactatggttgctttccctatttgttcaatagactgataatactggaatttatagagtttgagccattacaacttttgtgaggatgtgtttcaaacatttctggacaaatcttattttgtatttctggaagaatgtagtaatcttctagaccgcttaaaaccaatgctcccaagctgaatattcttgagaaatttgtttttattatgccatttgacatttcaaatcagtgctcatatacagtaaacttgtgatagaaattgtattttattgctttttggattataattcatataaatataattacttgaatattgtttgagatcattaacatgccagggcagttcccactgatttagatggtccaagataatctcattcaggaggcttgaaacattaatggtttagtcttgtgaattttaacagttctctgtcatcgtttaacaaaaccaacaactgacacaactccttaagctgtggtttcagtctctgctagttcatattgcatgtttattttggacagtcttttgttaagcatggtgcttgtactggtttaaataaaatgttaacattaaaa

SEQ ID NO: 454689 - DNA, 4089 bp, Homo sapiens
tgataggtgggggcgactgggccaggcgccggggcaggaagggaggcggccgccgtgccattcttaaaggcgcccgagtgtaggcgacaggccgctgacggccggaaggaaaatgagtgagtctttggttgtttgtgatgttgccgaagatttagtggaaaagctgagaaagtttcgttttcgcaaagaaacgaacaacgctgctattataatgaagattgacaaggataaacgcctggtggtactggatgaggagcttgagggcatttcaccagatgaacttaaagatgaactacctgaacgacaacctcgcttcattgtgtatagttataaatatcaacatgatgatggaagagtttcatatcctctgtgctttattttctccagtcctgttggatgtaagcctgaacaacagatgatgtatgctggaagtaagaataagctagtccagacagctgaactaaccaaggtatttgaaataagaaataccgaagacctaactgaagaatggttacgtgagaaacttggattttttcactaatgtgaacttctgtgtttctaaagtatttatgtattaacctgaccatactggaatcagacataaatacttatttatgcctaaaaatgcactgttacttacagtttgtttcctgcagtaaagaaaaattcttcatttgtgcaaaatttgtattggtaattgttaggtggactacttttctccagggactttttgcactcttgtgactaatttctataacttatggttcggaatttgttactatttacagacaccattggaaagtggatatattagattgtgagagacaacagttgcctccttttgacaaatactggatattagcagtttatttatgaaaatagcgtattatcacttgtcaaatcattgaaattcatttggggtcaaagacttgagtgacccagtattgagccatgaataatttagtgtaacctgtattacaagtacattgatgaattctgtatcttctttggtttcctgtatctttttaatcaagtctagaaactatgttcatcagtcactcatttttaaggtcgggagttagattttatgatagaattatgactgttagcttttctccttatagcatcttagtcttagaaattggtgggttgtaataatcaagggcttcattccttttatgtcatttctagacagttttgaatctaggttaataacactttatttataaagcacctcaatgtcctgtgaacactaattattttaaatgtgttaatactgtgcctttgatttgttagctttaaagttagtttaagacttttacactgccagtattccacatttggtgaaattaatacttttttaaagggtccaaataaaataattttctaatgtgtatatctgaaatttgtaataaaatcaacttcatattttaaaaattccaactatctgcttgcattggtgaatatatggcagtcgagagttataattttgggtatacttgtggttagttttgtgccataggaaaaaattatcttaaaactttggccatagttaataacattaacacttcaatagcaatcacatcttatatcctaaatgtcagaagatattctgaactggatgcctgaatagttaactaaaccagtcttgttagatgatggtactcttggcataaagcgaggattctgatatttggcatacttgtaaaaacaaatacataagtaaccattgaacattaatttgataataggtctagagactctaaaaactaaccaaacttggtgagtgtattcttatattaagaatatcttagtcatctcaaaactagcaaaatttaaattttggcatgttttccattcatatgttctttgcattttatttttgaggtttctgtgagaagtaaagatagttggaatttttgcgatattgaatagaacatcttctgttcccaacactgtttggcttcactaatttagaagtcaggaagcaatagaaagttggagatgaggaagtgctagagtaggtgtttgttttggttcttggagggaaaagattctttattccaatttccagagagaagagaaaactcacccaggaagtttaaaaattctttaaacaggtattttgatattggagaataacatgcatataattctgtaggaatgcacatgtaatccaagtgagtggagagtgtttttaatgtttttgaatgaaggaaatgaggttttgtttcacctgttttgcagcagtaagagaaactagtgctgcaagaatgtattttttaatgaagttccttattttgtcttgcatgttttagttttgcttatttttaaatttggaggtcctccataatgtcagataatattgacctgccatacgttagcactcttagttccgctactgtctttaacaggagcaaagagctgtgataaaccatgcttttttgagcttgtctgactcctaattaataacatgtttttggcaagacaacagattgaggttagaggatcagtaggacatttttattccatctgtcctatggggaaatttacaaatcccgtgctctaaaatgttctcaaacatttatatagatttccctttcatcttactaaattttgcattgttcttttcaagtatgtttcgtatttactgtctttttttctgccatttcccaaataataactccagatttcataattccagtttttacattccgttatctttctggtacaaccattcccattcagccttaaatctgagtcctttttagcagcaacttttttcctgggatcctccttcgtggtcttctaagtcagtgttagttttgaaatttttggccctgcataagttctgcatagcatctaatgtcaaaatagaaccaactggtaatcacagtattatttagtgtggtttccatgacaacaaaaatacatacgaagaaaacttctcaggttactatgctgaaattccaaaatgtctgagttttgaatagtgatcactttgttctggtattgacgcaattatattaggaaaaaagttggttgactgtttttgtttaattgacttctaaaatgttcaaattgtctagttctaaaagtttactaaatgcctagtgcagttaaacatactcttgtttaagtgtgtgttgctaaattttttactgtcattactaaataatctgtgtggcaaaatgtgtgtcagcacttttccctccttttttatctcctattttcaggagtcaaatgtagccataaactgtatccttgtctgacactttagctaaaaatttccagttaggggagtttattgccaaattaaatttggctgttccccccaacccatatagatattaaggaaggtgtacttaaaaaatgtttggactgcttttaaaacctgagcaatgtcattaatccatatgtggactagtgatgaatagatattttcataagagtttaaatgctgatatttggtggaagtagagagtaactcatattctatcaattcaagtattcttactatggttgctttccctatttgttcaatagactgataatactggaatttatagagtttgagccattacaacttttgtgaggatgtgtttcaaacatttctggacaaatcttattttgtatttctggaagaatgtagtaatcttctagaccgcttaaaaccaatgctcccaagctgaatattcttgagaaatttgtttttattatgccatttgacatttcaaatcagtgctcatatacagtaaacttgtgatagaaattgtattttattgctttttggattataattcatataaatataattacttgaatattgtttgagatcattaacatgccagggcagttcccactgatttagatggtccaagataatctcattcaggaggcttgaaacattaatggtttagtcttgtgaattttaacagttctctgtcatcgtttaacaaaaccaacaactgacacaactccttaagctgtggtttcagtctctgctagttcatattgcatgtttattttggacagtcttttgttaagcatggtgcttgtactggtttaaataaaatgttaacattaaaa

SEQ ID NO: 454690 - DNA, 159 bp, Homo sapiens
ctcttcctgcctatctgtcttcacgctgtgccccacggccattccccaccccgggcagcccccggactccaaaggtcgtggctgccacagcctccctcagctcttcctgcctatctgtcttcacactgagaatggcgcccaataaatgctatccacgga

SEQ ID NO: 454691 - DNA, 3055 bp, Homo sapiens
cggtgggtggtgctgaagggacagctccgcggcggcggcggcggcggcggccccgggcgctgagcgggtgccctgcgcggagagcggcgagcgcagccatgccccaggccgcctccggggcagcagcagcggcggcgcaacgtctacgcggaggtgctgcacttccagtccatgtgctcgtgcctgtggtacaagagccgcgagaagctgcagtactccatccccatgatcatcccgcgggacctctccacgtccgacacgtgcgtggagcagagccactcgtcgccgggagggggcggccgctacagcgacacgccctcgcgacgctgcctgtgcagcggggcgccacgctccgccatcagctcggtgtccacgggtctgcacagcctgtccaccttccgcggcctcatgaagcgcaggagctccgtgtgactgccccgagggacctggagcacctgggggcgcgggcgggggacccctgctgggaggccaggagactgcccctgctgccttctgcccagtgggaccccgcacaacatccctcaccactctcccccagcacccccatctccgactgtgcctgcttgcaccagccggcaggaggccgggctctgaggacccctggggcccccatcggagccctgcaaattccgagaaatgtgaaacttggtggggtcagggaggaaaggcagaagctgggagcctcccttccctttgaaaatctaagaagctcccagtcctcagagaccctgctggtacccagacccccaccttcggaggggacttcatgttccgtgtacgtttgcatctctatttatacctctgtcctgctaggtctcccaccttcccttggttccaaaagccagggtgtctatgtccaagtcacccctactcagccccactccccttcctcatccccagctgtgtctcccaacctcccttcgtgttgttttgcatggctttgcagttatggagaaagtggaaacccagcagtccctaaagctggtccccagaaagcaggacagaaagaaggagggacaggcaggcagcaggaggggcgagctgggaggcaggaggcagcggcctgtcagtctgcagaatggtcgcactggaggttcaagctaactggcctccagccacattctcatagcaggtaggacttcagccttccagacactgcccttagaatctggaacagaagacttcagactcaccataattgctgataattacccactcttaaatttgtcgagtgatttttagcctctgaaaactctatgctggccactgattcctttgagtctcacaaaaccctacttaggtcatcagggcaggagttctcactcccattttacagatgagaatactgaggcctggacaggtgaagtgaccagagagcaaaaggcaaaggggtgggggctgggtgcagtggctcacacctgtattcccaacacttttggaggctgaggttggaggattgcttgagcccaggaattcgagaccagcctaggtgacatagtgagaccccatctctacaaaaaataaaaaattaaccaggtgtggtggcacgtgcctgggagtcccagcgacttgggaggctgaggtgggaggattgtttgagcctgggaggtcgaggctgtagtgagccctgattgcaccactgtactccagcctgggtgacagggcaagaccctgtctcaaaaaaaaaaaaaaaaatggcaaagggagacaagagcccagcctgcttgttgctagccaaagtgttctttccttccagcttggcctgctcttaaaagcaaagctcctgcagtgtacatcctggcattgtgtggctacctgggttttaaaccagaatcagaagtcccggatcagagggcactgctgaggttcagcctcttctcttcttggccaggaggcagcagctctgaatgggcccctgaggctgcacaggggcctttgtcactggggcgcatgcttacaaacagtgcagttcttgggaccgaggtaagcagggctgggtctcatggcagaaaggccaggatctggggctctaggaatttgggaattgggcagagtggccaagaaagctggcaggcatatcctatgggacatcacacctggcaccattgtcattgttggtgcctgtgtcccaagtagctagtgataagctgaggctgcagcaagaaacacccttcccaggtgggggagtttggaccagaggtgccctctgcccaccacacctgcaacccagaagcccagatggaacgcagctgacgaaggtgatgcttgaggctcacttttggggccccacagctggagccggtataatgactgggacaacatcaaggggtggatgaggggcctctcctcccgcaacactgccttcccatgctgttcccctgccagctccttaacactgccgaccaaggccagccctggcattcagggaaattggagggcagcacccgtagggtggccagcctcaggccccaccccagctgtgtcctctagtctctggggacccctggggggaagaagtctaccctgcttgtgagtcccgtctcagtgtggaggaactggctgcacatgggacctgaaggtgccctctgtgtttatgttgggggtgggggggcagtgctggctgcctctgtcctgtgtgtgaccctaccctcgaagggtcctgtcctgtcagtcccgagggagccacaaccaaagctgcggagagaaggtggggaagggtgcggaatggccgtggggcacagcgtggcagactgttcagtctctgctgggtctttcctagggacctggaaggccagtgttgcttccccctcactccctttcactgcaggcagcctctctgcttccccaatgccttatgcctgggcacactgccacagaatatgcaatatgtgtgggtgaccatgccctcacgaccacacccccaccccgggcagcccccggactccaaaggtcgtggctgccacagcctccctcagctcttcctgcctatctgtcttcacactgagaatggcgcccaataaatgctatccacgga

SEQ ID NO: 454692 - DNA, 3020 bp, Homo sapiens
cggtgggtggtgctgaagggacagctccgcggcggcggcggcggcggcggccccgggcgctgagcgggtgccctgcgcggagagcggcgagcgcagccatgccccaggccgcctccggggcagcagcagcggcggccggggccgatgcgcgggccgggggcgccggggggccggcggcggcccgggcgggacgatgaagcggcagaacgtgcgcacgctggcgctcatcgtgtgcaccttcacctacctgctggtgggcgccgcggtcttcgacgcgctggagtcggagcccgagctgatcgagcggcagcggctggagctgcggcagcaggagctgcgggcgcgctacaacctcagccagggcggctacgaggagctggagcgcgtcgtgctgcgcctcaagccgcacaaggccggcgtgcagtggcgcttcgccggctccttctacttcgccatcaccgtcatcaccaccatcggctacgggcacgcggcacccagcacggatggcggcaaggtgttctgcatgttctacgcgctgctgggcatcccgctcacgctcgtcatgttccagagcctgggcgagcgcatcaacaccttggtgaggtacctgctgcaccgcgccaagaaggggctgggcatgcggcgcgccgacgtgtccatggccaacatggtgctcatcggcttcttctcgtgcatcagcacgctgtgcatcggcgccgccgccttctcccactacgagcactggaccttcttccaggcctactactactgcttcatcaccctcaccaccatcggcttcggcgactacgtggcgctgcagaaggaccaggccctgcagacgcagccgcagtacgtggccttcagcttcgtctacatccttacgggcctcacggtcatcggcgccttcctcaacctcgtggtgctgcgcttcatgaccatgaacgccgaggacgagaagcgcgacgccgagcaccgcgcgctgctcacgcgcaacgggcaggcgggcggcggcggagggggtggcagcgcgcacactacggacaccgcctcatccacggcggcagcgggcggcggcggcttccgcaacgtctacgcggaggtgctgcacttccagtccatgtgctcgtgcctgtggtacaagagccgcgagaagctgcagtactccatccccatgatcatcccgcgggacctctccacgtccgacacgtgcgtggagcagagccactcgtcgccgggagggggcggccgctacagcgacacgccctcgcgacgctgcctgtgcagcggggcgccacgctccgccatcagctcggtgtccacgggtctgcacagcctgtccaccttccgcggcctcatgaagcgcaggagctccgtgtgactgccccgagggacctggagcacctgggggcgcgggcgggggacccctgctgggaggccaggagactgcccctgctgccttctgcccagtgggaccccgcacaacatccctcaccactctcccccagcacccccatctccgactgtgcctgcttgcaccagccggcaggaggccgggctctgaggacccctggggcccccatcggagccctgcaaattccgagaaatgtgaaacttggtggggtcagggaggaaaggcagaagctgggagcctcccttccctttgaaaatctaagaagctcccagtcctcagagaccctgctggtacccagacccccaccttcggaggggacttcatgttccgtcttggcctgctcttaaaagcaaagctcctgcagtgtacatcctggcattgtgtggctacctgggttttaaaccagaatcagaagtcccggatcagagggcactgctgaggttcagcctcttctcttcttggccaggaggcagcagctctgaatgggcccctgaggctgcacaggggcctttgtcactggggcgcatgcttacaaacagtgcagttcttgggaccgaggtaagcagggctgggtctcatggcagaaaggccaggatctggggctctaggaatttgggaattgggcagagtggccaagaaagctggcaggcatatcctatgggacatcacacctggcaccattgtcattgttggtgcctgtgtcccaagtagctagtgataagctgaggctgcagcaagaaacacccttcccaggtgggggagtttggaccagaggtgccctctgcccaccacacctgcaacccagaagcccagatggaacgcagctgacgaaggtgatgcttgaggctcacttttggggccccacagctggagccggtataatgactgggacaacatcaaggggtggatgaggggcctctcctcccgcaacactgccttcccatgctgttcccctgccagctccttaacactgccgaccaaggccagccctggcattcagggaaattggagggcagcacccgtagggtggccagcctcaggccccaccccagctgtgtcctctagtctctggggacccctggggggaagaagtctaccctgcttgtgagtcccgtctcagtgtggaggaactggctgcacatgggacctgaaggtgccctctgtgtttatgttgggggtgggggggcagtgctggctgcctctgtcctgtgtgtgaccctaccctcgaagggtcctgtcctgtcagtcccgagggagccacaaccaaagctgcggagagaaggtggggaagggtgcggaatggccgtggggcacagcgtggcagactgttcagtctctgctgggtctttcctagggacctggaaggccagtgttgcttccccctcactccctttcactgcaggcagcctctctgcttccccaatgccttatgcctgggcacactgccacagaatatgcaatatgtgtgggtgaccatgccctcacgaccacacccccaccccgggcagcccccggactccaaaggtcgtggctgccacagcctccctcagctcttcctgcctatctgtcttcacactgagaatggcgcccaataaatgctatccacgga

SEQ ID NO: 454693 - DNA, 4001 bp, Homo sapiens
cggtgggtggtgctgaagggacagctccgcggcggcggcggcggcggcggccccgggcgctgagcgggtgccctgcgcggagagcggcgagcgcagccatgccccaggccgcctccggggcagcagcagcggcggccggggccgatgcgcgggccgggggcgccggggggccggcggcggcccgggcgggacgatgaagcggcagaacgtgcgcacgctggcgctcatcgtgtgcaccttcacctacctgctggtgggcgccgcggtcttcgacgcgctggagtcggagcccgagctgatcgagcggcagcggctggagctgcggcagcaggagctgcgggcgcgctacaacctcagccagggcggctacgaggagctggagcgcgtcgtgctgcgcctcaagccgcacaaggccggcgtgcagtggcgcttcgccggctccttctacttcgccatcaccgtcatcaccaccatcggctacgggcacgcggcacccagcacggatggcggcaaggtgttctgcatgttctacgcgctgctgggcatcccgctcacgctcgtcatgttccagagcctgggcgagcgcatcaacaccttggtgaggtacctgctgcaccgcgccaagaaggggctgggcatgcggcgcgccgacgtgtccatggccaacatggtgctcatcggcttcttctcgtgcatcagcacgctgtgcatcggcgccgccgccttctcccactacgagcactggaccttcttccaggcctactactactgcttcatcaccctcaccaccatcggcttcggcgactacgtggcgctgcagaaggaccaggccctgcagacgcagccgcagtacgtggccttcagcttcgtctacatccttacgggcctcacggtcatcggcgccttcctcaacctcgtggtgctgcgcttcatgaccatgaacgccgaggacgagaagcgcgacgccgagcaccgcgcgctgctcacgcgcaacgggcaggcgggcggcggcggagggggtggcagcgcgcacactacggacaccgcctcatccacggcggcagcgggcggcggcggcttccgcaacgtctacgcggaggtgctgcacttccagtccatgtgctcgtgcctgtggtacaagagccgcgagaagctgcagtactccatccccatgatcatcccgcgggacctctccacgtccgacacgtgcgtggagcagagccactcgtcgccgggagggggcggccgctacagcgacacgccctcgcgacgctgcctgtgcagcggggcgccacgctccgccatcagctcggtgtccacgggtctgcacagcctgtccaccttccgcggcctcatgaagcgcaggagctccgtgtgactgccccgagggacctggagcacctgggggcgcgggcgggggacccctgctgggaggccaggagactgcccctgctgccttctgcccagtgggaccccgcacaacatccctcaccactctcccccagcacccccatctccgactgtgcctgcttgcaccagccggcaggaggccgggctctgaggacccctggggcccccatcggagccctgcaaattccgagaaatgtgaaacttggtggggtcagggaggaaaggcagaagctgggagcctcccttccctttgaaaatctaagaagctcccagtcctcagagaccctgctggtacccagacccccaccttcggaggggacttcatgttccgtgtacgtttgcatctctatttatacctctgtcctgctaggtctcccaccttcccttggttccaaaagccagggtgtctatgtccaagtcacccctactcagccccactccccttcctcatccccagctgtgtctcccaacctcccttcgtgttgttttgcatggctttgcagttatggagaaagtggaaacccagcagtccctaaagctggtccccagaaagcaggacagaaagaaggagggacaggcaggcagcaggaggggcgagctgggaggcaggaggcagcggcctgtcagtctgcagaatggtcgcactggaggttcaagctaactggcctccagccacattctcatagcaggtaggacttcagccttccagacactgcccttagaatctggaacagaagacttcagactcaccataattgctgataattacccactcttaaatttgtcgagtgatttttagcctctgaaaactctatgctggccactgattcctttgagtctcacaaaaccctacttaggtcatcagggcaggagttctcactcccattttacagatgagaatactgaggcctggacaggtgaagtgaccagagagcaaaaggcaaaggggtgggggctgggtgcagtggctcacacctgtattcccaacacttttggaggctgaggttggaggattgcttgagcccaggaattcgagaccagcctaggtgacatagtgagaccccatctctacaaaaaataaaaaattaaccaggtgtggtggcacgtgcctgggagtcccagcgacttgggaggctgaggtgggaggattgtttgagcctgggaggtcgaggctgtagtgagccctgattgcaccactgtactccagcctgggtgacagggcaagaccctgtctcaaaaaaaaaaaaaaaaatggcaaagggagacaagagcccagcctgcttgttgctagccaaagtgttctttccttccagcttggcctgctcttaaaagcaaagctcctgcagtgtacatcctggcattgtgtggctacctgggttttaaaccagaatcagaagtcccggatcagagggcactgctgaggttcagcctcttctcttcttggccaggaggcagcagctctgaatgggcccctgaggctgcacaggggcctttgtcactggggcgcatgcttacaaacagtgcagttcttgggaccgaggtaagcagggctgggtctcatggcagaaaggccaggatctggggctctaggaatttgggaattgggcagagtggccaagaaagctggcaggcatatcctatgggacatcacacctggcaccattgtcattgttggtgcctgtgtcccaagtagctagtgataagctgaggctgcagcaagaaacacccttcccaggtgggggagtttggaccagaggtgccctctgcccaccacacctgcaacccagaagcccagatggaacgcagctgacgaaggtgatgcttgaggctcacttttggggccccacagctggagccggtataatgactgggacaacatcaaggggtggatgaggggcctctcctcccgcaacactgccttcccatgctgttcccctgccagctccttaacactgccgaccaaggccagccctggcattcagggaaattggagggcagcacccgtagggtggccagcctcaggccccaccccagctgtgtcctctagtctctggggacccctggggggaagaagtctaccctgcttgtgagtcccgtctcagtgtggaggaactggctgcacatgggacctgaaggtgccctctgtgtttatgttgggggtgggggggcagtgctggctgcctctgtcctgtgtgtgaccctaccctcgaagggtcctgtcctgtcagtcccgagggagccacaaccaaagctgcggagagaaggtggggaagggtgcggaatggccgtggggcacagcgtggcagactgttcagtctctgctgggtctttcctagggacctggaaggccagtgttgcttccccctcactccctttcactgcaggcagcctctctgcttccccaatgccttatgcctgggcacactgccacagaatatgcaatatgtgtgggtgaccatgccctcacgaccacacccccaccccgggcagcccccggactccaaaggtcgtggctgccacagcctccctcagctcttcctgcctatctgtcttcacactgagaatggcgcccaataaatgctatccacgga

SEQ ID NO: 454694 - DNA, 2275 bp, Homo sapiens
cggtgggtggtgctgaagggacagctccgcggcggcggcggcggcggcggccccgggcgctgagcgggtgccctgcgcggagagcggcgagcgcagccatgccccaggccgcctccggggcagcagcagcggcggccggggccgatgcgcgggccgggggcgccggggggccggcggcggcccgggcgggacgatgaagcggcagaacgtgcgcacgctggcgctcatcgtgtgcaccttcacctacctgctggtgggcgccgcggtcttcgacgcgctggagtcggagcccgagctgatcgagcggcagcggctggagctgcggcagcaggagctgcgggcgcgctacaacctcagccagggcggctacgaggagctggagcgcgtcgtgctgcgcctcaagccgcacaaggccggcgtgcagtggcgcttcgccggctccttctacttcgccatcaccgtcatcaccaccatcggctacgggcacgcggcacccagcacggatggcggcaaggtgttctgcatgttctacgcgctgctgggcatcccgctcacgctcgtcatgttccagagcctgggcgagcgcatcaacaccttggtgaggtacctgctgcaccgcgccaagaaggggctgggcatgcggcgcgccgacgtgtccatggccaacatggtgctcatcggcttcttctcgtgcatcagcacgctgtgcatcggcgccgccgccttctcccactacgagcactggaccttcttccaggcctactactactgcttcatcaccctcaccaccatcggcttcggcgactacgtggcgctgcagaaggaccaggccctgcagacgcagccgcagtacgtggccttcagcttcgtctacatccttacgggcctcacggtcatcggcgccttcctcaacctcgtggtgctgcgcttcatgaccatgaacgccgaggacgagaagcgcgacgccgagcaccgcgcgctgctcacgcgcaacgggcaggcgggcggcggcggagggggtggcagcgcgcacactacggacaccgcctcatccacggcggcagcgggcggcggcggcttccgcaacgtctacgcggaggtgctgcacttccagtccatgtgctcgtgcctgtggtacaagagccgcgagaagctgcagtactccatccccatgatcatcccgcgggacctctccacgtccgacacgtgcgtggagcagagccactcgtcgccgggagggggcggccgctacagcgacacgccctcgcgacgctgcctgtgcagcggggcgccacgctccgccatcagctcggtgtccacgggtctgcacagcctgtccaccttccgcggcctcatgaagcgcaggagctccgtgtgactgccccgagggacctggagcacctgggggcgcgggcgggggacccctgctgggaggccaggagactgcccctgctgccttctgcccagtgggaccccgcacaacatccctcaccactctcccccagcacccccatctccgactgtgcctgcttgcaccagccggcaggaggccgggctctgaggacccctggggcccccatcggagccctgcaaattccgagaaatgtgaaacttggtggggtcagggaggaaaggcagaagctgggagcctcccttccctttgaaaatctaagaagctcccagtcctcagagaccctgctggtacccagacccccaccttcggaggggacttcatgttccgtgtacgtttgcatctctatttatacctctgtcctgctaggtctcccaccttcccttggttccaaaagccagggtgtctatgtccaagtcacccctactcagccccactccccttcctcatccccagctgtgtctcccaacctcccttcgtgttgttttgcatggctttgcagttatggagaaagtggaaacccagcagtccctaaagctggtccccagaaagcaggacagaaagaaggagggacaggcaggcagcaggaggggcgagctgggaggcaggaggcagcggcctgtcagtctgcagaatggtcgcactggaggttcaagctaactggcctccagccacattctcatagcaggtaggacttcagccttccagacactgcccttagaatctggaacagaagacttcagactcaccataattgctgataattacccactcttaaatttgtcgagtgatttttagcctctggtcacttcacctgtccaggcctcagtattctcatctgtaaaatgggagtgagaactcctg

SEQ ID NO: 454695 - DNA, 1992 bp, Homo sapiens
aggcgccgcgcgtgggcggggcgtcggcggcagcagggcggctgaggtggccgctggagctcaggcggcgggcgcggctgggatggcgaagagcaacggagagaatgggccgcgcgcgcccgcggccggggaaagcctgtcgggaacccgggagagcctggcccagggccccgacgccgcaaccaccgacgaactcagctctctcgggtctgactcggaggccaacggcttcgccgagcgccgcatcgacaagttcggcttcatcgtgggctcgcagggcgccgagggcgcgctggaggaagtacccctggaggtgctgaggcagagggagtccaagtggctggacatgctcaacaactgggacaaatggatggccaagaagcacaaaaagattcgtctgcggtgccaaaagggcatcccgccttctctgcggggccgtgcttggcagtacctgtcaggaggcaaggtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgccttctcccgaaccttgccctggagctctgtgctgcgtgtctgggacatgttcttctgtgaaggggtcaagatcatcttccgggtggggctggtgctgctgaagcacgcgctgggctcccctgagaaggtcaaagcctgccagggccagtacgagaccatcgagcgactgcggagcctcagccccaagatcatgcaggaggcctttctggtccaggaggtggtggagttgcccgtgacagagcgccagattgagcgcgaacacctcattcagctgcggcgctggcaggagacccggggtgagctgcagtgccgctccccgcccaggctgcatggtgccaaggctatcttggatgcagaacctggtccccggcctgccctacaaccttcaccatccatccgcctgcccctagatgcccccctccctggctccaaagccaagcccaagccacccaagcaggcccagaaggagcagcggaaacagatgaaggggagagggcagctggagaagcccccagccccaaatcaagccatggtggtggccgctgcaggagatgcatgtcccccacagcatgtgcccccgaaggactcagcccccaaggactcagcccctcaggatttggctccccaggtctcagcccaccaccgctcccaggagagcttgacgtcccaagagagtgaggacacctacttgtaaccctggcagctaaggcctccagggcggggtctccatataactacacggttcatgaactgacattccacatcctgcccaccctctgagggccaagctgcctggccactgggctgggctggagtctggctggtccaacacagattctgcctggtccaacacagattctgcctgagcctccttatttattttctttacagtggcactcaggctggcccagccagggcaggcagaagctagggcctggggggtggggcctccttcagccccctcctcctgggggatgctccccagggttagggtgctggtgtgaggggaaagggtggggtgttctttgtgtaaaatagaaacatggttttgtacagaaataaacagccttgtataga

SEQ ID NO: 454696 - DNA, 550 bp, Homo sapiens
gggcggtacgctaatgcgcgacacggggacaagtggatggcaagaagcacaaaaagattcgtctgcggtgccaaaagggcatcccgccttctctgcggggccgtgcttggcagtacctgtcaggaggcaaggtgaagttacagcagaaccctggaaagtttgacgtaagtttcccttcctttgccctgccctcccttccgcatctcttggcgtcctccccatggcggcaatcctccatgtgctcacctgaacctcacaggatgagcagtccatgaaacctccagtcatgtgcccaactgcccaggccccagcaggccagaccggcccagtcctgggtacctgtgtctcctggagggtctgtacaactgaggctccagccctgagcagccctcagtggaatggccagatttggtaccccctattccagctctttctcttgatgaccactcaggttttgctttcctgggctcagtaggctacctccctgctcttggtcatcaggaggggacactcagaccatttccctgactgccttgggccctgtgccctg

SEQ ID NO: 454697 - DNA, 2396 bp, Homo sapiens
aggcgccgcgcgtgggcggggcgtcggcggcagcagggcggctgaggtggccgctggagctcaggcggcgggcgcggctgggatggcgaagagcaacggagagaatgggccgcgcgcgcccgcggccggggaaagcctgtcgggaacccgggagagcctggcccagggccccgacgccgcaaccaccgacgaactcagctctctcgggtctgactcggaggccaacggcttcgccgagcgccgcatcgacaagttcggcttcatcgtgggctcgcagggcgccgagggcgcgctggaggaagtacccctggaggtgctgaggcagagggagtccaagtggctggacatgctcaacaactgggacaaatggatggccaagaagcacaaaaagattcgtctgcggtgccaaaagggcatcccgccttctctgcggggccgtgcttggcagtacctgtcaggaggcaaggtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgccttctcccgaaccttgccctggagctctgtgctgcgtgtctgggacatgttcttctgtgaaggggtcaagatcatcttccgggtggggctggtgctgctgaagcacgcgctgggctcccctgagaaggtcaaagcctgccagggccagtacgagaccatcgagcgactgcggagcctcagccccaagatcatgcaggaggcctttctggtccaggaggtggtggagttgcccgtgacagagcgccagattgagcgcgaacacctcattcagctgcggcgctggcaggagacccgggagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgcacccccaaggaggcagcctctagcagtcctgaacccagctccatcacgttctttgccttctccctcatcgagggttatatctccattgtcatggatgctgaaacacagaaaaagttccccagtgacctcctgctgaccagctcctcgggggagctgtggaggatggtgcgcatcggtggacagcccctgggctttgatgaatgtggcatcgtggcacagattgcaggtcccctggctgccgctgacatctctgcctactacatcagcaccttcaacttcgaccacgccctgggtgcccgaggacggtatcggcagcgtcatcgaggtcctccagcggcggcaggaaggcctggcttcctgaggcccatgggcaacagagcagcctccctgctctcccctcgacccaggcttccaaagacttctctaagctatttccttaagctctggaacgagccccctgttctgctggggaccctcgttccgctctctgtatgtaagctgcgtgcaggcaccggcttttacgcggacacctgtgtacactcacaggtggagtgggcaggtgctagcctgactgcgtgtctgcccatgcaggggaacacggtgctcggggcttaagcccccaacccatcactccctgcgcagcctcggcgtttgcacagtccctgcctgaggcctgagccattccccaaaggcttcctgggccagctgcccccctgacctccgttctgcctctggtggggttgccttccctggccaggtgagtcctgacagtgcctctccctcctggggcctccaaggaaagtattttgacatctctctctcttctgtttttattgacttgttaataaaggactttgtagtga

SEQ ID NO: 454698 - DNA, 2989 bp, Homo sapiens
aggcgccgcgcgtgggcggggcgtcggcggcagcagggcggctgaggtggccgctggagctcaggcggcgggcgcggctgggatggcgaagagcaacggagagaatgggccgcgcgcgcccgcggccggggaaagcctgtcgggaacccgggagagcctggcccagggccccgacgccgcaaccaccgacgaactcagctctctcgggtctgactcggaggccaacggcttcgccgagcgccgcatcgacaagttcggcttcatcgtgggctcgcagggcgccgagggcgcgctggaggaagtacccctggaggtgctgaggcagagggagtccaagtggctggacatgctcaacaactgggacaaatggatggccaagaagcacaaaaagattcgtctgcggtgccaaaagggcatcccgccttctctgcggggccgtgcttggcagtacctgtcaggaggcaaggtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgccttctcccgaaccttgccctggagctctgtgctgcgtgtctgggacatgttcttctgtgaaggggtcaagatcatcttccgggtggggctggtgctgctgaagcacgcgctgggctcccctgagaaggtcaaagcctgccagggccagtacgagaccatcgagcgactgcggagcctcagccccaagatcatgcaggaggcctttctggtccaggaggtggtggagttgcccgtgacagagcgccagattgagcgcgaacacctcattcagctgcggcgctggcaggagacccgggagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacagcacccccaaggaggcagcctctagcagtcctgaacccagctccatcacgttctttgccttctccctcatcgagggttatatctccattgtcatggatgctgaaacacagaaaaagttccccagtgacctcctgctgaccagctcctcgggggagctgtggaggatggtgcgcatcggtggacagcccctgggctttgatgaatgtggcatcgtggcacagattgcaggtcccctggctgccgctgacatctctgcctactacatcagcaccttcaacttcgaccacgccctgggtgcccgaggacggtatcggcagcgtcatcgaggtcctccagcggcggcaggaaggcctggcttcctgaggcccatgggcaacagagcagcctccctgctctcccctcgacccaggcttccaaagacttctctaagctatttccttaagctctggaacgagccccctgttctgctggggaccctcgttccgctctctgtatgtaagctgcgtgcaggcaccggcttttacgcggacacctgtgtacactcacaggtggagtgggcaggtgctagcctgactgcgtgtctgcccatgcaggggaacacggtgctcggggcttaagcccccaacccatcactccctgcgcagcctcggcgtttgcacagtccctgcctgaggcctgagccattccccaaaggcttcctgggccagctgcccccctgacctccgttctgcctctggtggggttgccttccctggccaggtgagtcctgacagtgcctctccctcctggggcctccaaggaaagtattttgacatctctctctcttctgtttttattgacttgttaataaaggactttgtagtgaagataagaaacaaaagaatagggaaaaaaaaataataaccaaaaagcgggggccacgccctaaaatgttccctccgggttcggccaaagatgttggtcctgccgcctgtttgctgagcaacgaatagggggccccgcaatgggaggtgcctttataaaaagacgcaggggcacctgtggtcaaaaaaaacgacagtagggcgcagagaaaactcgagtgtccagtggcgcaccttggcgtgagagaaaccacctgtatccatggtggatggggaacgcccctgttggcagcggacacaatgcctccaaccggtaaacacttggaacgccctacaaaggggatccactatcaaacaattgtaagtgggggctaacgggggtgtaacaattggctggataatgtctgacgaacatggagagcttggaaagcgaggggcaatcccaatatggacagagttttaaccaggtac

SEQ ID NO: 454699 - DNA, 1843 bp, Homo sapiens
gttgcgcgggctgacgcgccactatgtagcgggtttcgggcgggccacgcgtgcgggacaggaacccaaccccagccgaccttgagctccaggagttcgtctcttacgtctgcggaagtgcagctgcctcagttcttagcgcgctggaggaagtacccctggaggtgctgaggcagagggagtccaagtggctggacatgctcaacaactgggacaaatggatggccaagaagcacaaaaagattcgtctgcggtgccaaaagggcatcccgccttctctgcggggccgtgcttggcagtacctgtcaggaggcaaggtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgccttctcccgaaccttgccctggagctctgtgctgcgtgtctgggacatgttcttctgtgaaggggtcaagatcatcttccgggtggggctggtgctgctgaagcacgcgctgggctcccctgagaaggtcaaagcctgccagggccagtacgagaccatcgagcgactgcggagcctcagccccaagatcatgcaggaggcctttctggtccaggaggtggtggagttgcccgtgacagagcgccagattgagcgcgaacacctcattcagctgcggcgctggcaggagacccggggtgagctgcagtgccgctccccgcccaggctgcatggtgccaaggctatcttggatgcagaacctggtccccggcctgccctacaaccttcaccatccatccgcctgcccctagatgcccccctccctggctccaaagccaagcccaagccacccaagcaggcccagaaggagcagcggaaacagatgaaggggagagggcagctggagaagcccccagccccaaatcaagccatggtggtggccgctgcaggagatgcatgtcccccacagcatgtgcccccgaaggactcagcccccaaggactcagcccctcaggatttggctccccaggtctcagcccaccaccgctcccaggagagcttgacgtcccaagagagtgaggacacctacttgtaaccctggcagctaaggcctccagggcggggtctccatataactacacggttcatgaactgacattccacatcctgcccaccctctgagggccaagctgcctggccactgggctgggctggagtctggctggtccaacacagattctgcctggtccaacacagattctgcctgagcctccttatttattttctttacagtggcactcaggctggcccagccagggcaggcagaagctagggcctggggggtggggcctccttcagccccctcctcctgggggatgctccccagggttagggtgctggtgtgaggggaaagggtggggtgttctttgtgtaaaatagaaacatggttttgtacagaaataaacagccttgtataga

SEQ ID NO: 454700 - DNA, 1782 bp, Homo sapiens
aggcgccgcgcgtgggcggggcgtcggcggcagcagggcggctgaggtggccgctggagctcaggcggcgggcgcggctgggatggcgaagagcaacggagagaatgggccgcgcgcgcccgcggccggggaaagcctgtcgggaacccgggagagcctggcccagggccccgacgccgcaaccaccgacgaactcagctctctcgggtctgactcggaggccaacggcttcgccgagcgccgcatcgacaagttcggcttcatcgtgggctcgcagggcgccgagggcgcgctggaggaagtacccctggaggtgctgaggcagagggagtccaagtggctggacatgctcaacaactgggacaaatggatggccaagaagcacaaaaagattcgtctgcggtgccaaaagggcatcccgccttctctgcggggccgtgcttggcagtacctgtcaggaggcaaggtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgccttctcccgaaccttgccctggagctctgtgctgcgtgtctgggacatgttcttctgtgaaggggtcaagatcatcttccgggtggggctggtgctgctgaagcacgcgctgggctcccctgagaaggtcaaagcctgccagggccagtacgagaccatcgagcgactgcggagcctcagccccaagatcatgcaggaggcctttctggtccaggaggtggtggagttgcccgtgacagagcgccagattgagcgcgaacacctcattcagctgcggcgctggcaggagacccgggagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtggagtgggcaggtgctagcctgactgcgtgtctgcccatgcaggggaacacggtgctcggggcttaagcccccaacccatcactccctgcgcagcctcggcgtttgcacagtccctgcctgaggcctgagccattccccaaaggcttcctgggccagctgcccccctgacctccgttctgcctctggtggggttgccttccctggccaggtgagtcctgacagtgcctctccctcctggggcctccaaggaaagtattttgacatctctctctcttctgtttttattgacttgttaataaaggactttgtagtga

SEQ ID NO: 454701 - DNA, 1567 bp, Homo sapiens
aagcttggcacgaggctggaagaattcgcggcctgggtctagttggcggcggggtcgggtccgcgcgagccgcgatggagctgcacatcctagaacaccgggtgcgggtgctgagcgtcgcccgtcccggtctctggctctacacccacccgctcatcaagctgctcttcctgccccgccgcagccggtgcaagttcttcagcctgacggagacccctgaggattacacgcttatggtggacgaggagggctttaaagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacagcacccccaaggaggcagcctctagcagtcctgaacccagctccatcacgttctttgccttctccctcatcgagggttatatctccattgtcatggatgctgaaacacagaaaaagttccccagtgacctcctgctgaccagctcctcgggggagctgtggaggatggtgcgcatcggtggacagcccctgggctttgatgaatgtggcatcgtggcacagattgcaggtcccctggctgccgctgacatctctgcctactacatcagcaccttcaacttcgaccacgccctgggtgcccgaggacggtatcggcagcgtcatcgaggtcctccagcggcggcaggaaggcctggcttcctgaggcccatgggcaacagagcagcctccctgctctcccctcgacccaggcttccaaagacttctctaagctatttccttaagctctggaacgagccccctgttctgctggggaccctcgttccgctctctgtatgtaagctgcgtgcaggcaccggcttttacgcggacacctgtgtacactcacaggtggagtgggcaggtgctagcctgactgcgtgtctgcccatgcaggggaacacggtgctcggggcttaagcccccaacccatcactccctgcgcagcctcggcgtttgcacagtccctgcctgaggcctgagccattccccaaaggcttcctgggccagctgcccccctgacctccgttctgcctctggtggggttgccttccctggccaggtgagtcctgacagtgcctctccctcctggggcctccaaggaaagtattttgacatctctctctcttctgtttttattgacttgttaataaaggactttgtagtga

SEQ ID NO: 454702 - DNA, 1679 bp, Homo sapiens
cgggatcgggcagaaccgcgatgaagcgtgcagcagtctataagcaccgggtgcggatgctgagcgatctcccgtgccggtctctgtgtctatgcccacaccgcatcctcaatcttggtcttaccatgccccaatgcagtgtggctgcagtgttacttactactgtggatcggataacccgctgtagtgacttactagcagctataatgagtgcgacgaagagaaggcgcttgtatatgatactctggcgatcattctgagatgggatggctactctcctccattcaacctgtagtcttgctaaatgtcgcccctggtggtgccatgtggtacaaagcttctgctaacccacagaagacaccgtagtgagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacagcacccccaaggaggcagcctctagcagtcctgaacccagctccatcacgttctttgccttctccctcatcgagggttatatctccattgtcatggatgctgaaacacagaaaaagttccccagtgacctcctgctgaccagctcctcgggggagctgtggaggatggtgcgcatcggtggacagcccctgggctttgatgaatgtggcatcgtggcacagattgcaggtcccctggctgccgctgacatctctgcctactacatcagcaccttcaacttcgaccacgccctgggtgcccgaggacggtatcggcagcgtcatcgaggtcctccagcggcggcaggaaggcctggcttcctgaggcccatgggcaacagagcagcctccctgctctcccctcgacccaggcttccaaagacttctctaagctatttccttaagctctggaacgagccccctgttctgctggggaccctcgttccgctctctgtatgtaagctgcgtgcaggcaccggcttttacgcggacacctgtgtacactcacaggtggagtgggcaggtgctagcctgactgcgtgtctgcccatgcaggggaacacggtgctcggggcttaagcccccaacccatcactccctgcgcagcctcggcgtttgcacagtccctgcctgaggcctgagccattccccaaaggcttcctgggccagctgcccccctgacctccgttctgcctctggtggggttgccttccctggccaggtgagtcctgacagtgcctctccctcctggggcctccaaggaaagtattttgacatctctctctcttctgtttttattgacttgttaataaaggactttgtagtga

SEQ ID NO: 454703 - DNA, 1453 bp, Homo sapiens
aagcttggcacgaggctggaagaattcgcggcctgggtctagttggcggcggggtcgggtccgcgcgagccgcgatggagctgcacatcctagaacaccgggtgcgggtgctgagcgtcgcccgtcccggtctctggctctacacccacccgctcatcaagctgctcttcctgccccgccgcagccggtgcaagttcttcagcctgacggagacccctgaggattacacgcttatggtggacgaggagggctttaaagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacaggttccccagtgacctcctgctgaccagctcctcgggggagctgtggaggatggtgcgcatcggtggacagcccctgggctttgatgaatgtggcatcgtggcacagattgcaggtcccctggctgccgctgacatctctgcctactacatcagcaccttcaacttcgaccacgccctgggtgcccgaggacggtatcggcagcgtcatcgaggtcctccagcggcggcaggaaggcctggcttcctgaggcccatgggcaacagagcagcctccctgctctcccctcgacccaggcttccaaagacttctctaagctatttccttaagctctggaacgagccccctgttctgctggggaccctcgttccgctctctgtatgtaagctgcgtgcaggcaccggcttttacgcggacacctgtgtacactcacaggtggagtgggcaggtgctagcctgactgcgtgtctgcccatgcaggggaacacggtgctcggggcttaagcccccaacccatcactccctgcgcagcctcggcgtttgcacagtccctgcctgaggcctgagccattccccaaaggcttcctgggccagctgcccccctgacctccgttctgcctctggtggggttgccttccctggccaggtgagtcctgacagtgcctctccctcctggggcctccaaggaaagtattttgacatctctctctcttctgtttttattgacttgttaataaaggactttgtagtga

SEQ ID NO: 454704 - DNA, 990 bp, Homo sapiens
aagcttggcacgaggctggaagaattcgcggcctgggtctagttggcggcggggtcgggtccgcgcgagccgcgatggagctgcacatcctagaacaccgggtgcgggtgctgagcgtcgcccgtcccggtctctggctctacacccacccgctcatcaagctgctcttcctgccccgccgcagccggtgcaagttcttcagcctgacggagacccctgaggattacacgcttatggtggacgaggagggctttaaagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacaggtggaccttggaacttcgtctttgtcctcacagcactgttccctacactctgtcccaccactttccgcccatctatcagttttgcacctcttgcttgtcctctcttggggttcctggcagcccatgatgctcacttgtgcttcactgatgttcggggaaggttcttgccccaaagctggatccctttccagtggggtcgtctgagccatgccctggtctggccctctcaccgtggaatcctttgtttttggcacaggctgggttcattgtcctcccccatccccacc

SEQ ID NO: 454705 - DNA, 2520 bp, Homo sapiens
aggcgccgcgcgtgggcggggcgtcggcggcagcagggcggctgaggtggccgctggagctcaggcggcgggcgcggctgggatggcgaagagcaacggagagaatgggccgcgcgcgcccgcggccggggaaagcctgtcgggaacccgggagagcctggcccagggccccgacgccgcaaccaccgacgaactcagctctctcgggtctgactcggaggccaacggcttcgccgagcgccgcatcgacaagttcggcttcatcgtgggctcgcagggcgccgagggcgcgctggaggaagtacccctggaggtgctgaggcagagggagtccaagtggctggacatgctcaacaactgggacaaatggatggccaagaagcacaaaaagattcgtctgcggtgccaaaagggcatcccgccttctctgcggggccgtgcttggcagtacctgtcaggaggcaaggtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgccttctcccgaaccttgccctggagctctgtgctgcgtgtctgggacatgttcttctgtgaaggggtcaagatcatcttccgggtggggctggtgctgctgaagcacgcgctgggctcccctgagaaggtcaaagcctgccagggccagtacgagaccatcgagcgactgcggagcctcagccccaagatcatgcaggaggcctttctggtccaggaggtggtggagttgcccgtgacagagcgccagattgagcgcgaacacctcattcagctgcggcgctggcaggagacccgggagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacagcacccccaaggaggcagcctctagcagtcctgaacccagctccatcacgttctttgccttctccctcatcgagggttatatctccattgtcatggatgctgaaacacagaaaaagttccccagtgacctcctgctgaccagctcctcgggggagctgtggaggatggtgcgcatcggtggacagcccctgggctttgatgaatgtggcatcgtggcacagattgcaggtcccctggctgccgctgacatctctgcctactacatcagcaccttcaacttcgaccacgccctgggtgcccgaggacggtatcggcagcgtcatcgaggtcctccagcggcggcaggaaggcctggcttcctgaggcccatgggcaacagagcagcctccctgctctcccctcgacccaggcttccaaagacttctctaagctatttccttaagctctggaacgagccccctgttctgctggggaccctcgttccgctctctgtatgtaagctgcgtgcaggcaccggcttttacgcggacacctgtgtacactcacaggtggagtgggcaggtgctagcctgactgcgtgtctgcccatgcaggggaacacggtgctcggggcttaagcccccaacccatcactccctgcgcagcctcggcgtttgcacagtccctgcctgaggcctgagccattccccaaaggcttcctgggccagctgcccccctgacctccgttctgcctctggtggggttgccttccctggccaggtgagtcctgacagtgcctctccctcctggggcctccaaggaaagtattttgacatctctctctcttctgtttttattgacttgttaataaaggactttgtagtga

SEQ ID NO: 454706 - DNA, 2282 bp, Homo sapiens
aggcgccgcgcgtgggcggggcgtcggcggcagcagggcggctgaggtggccgctggagctcaggcggcgggcgcggctgggatggcgaagagcaacggagagaatgggccgcgcgcgcccgcggccggggaaagcctgtcgggaacccgggagagcctggcccagggccccgacgccgcaaccaccgacgaactcagctctctcgggtctgactcggaggccaacggcttcgccgagcgccgcatcgacaagttcggcttcatcgtgggctcgcagggcgccgagggcgcgctggaggaagtacccctggaggtgctgaggcagagggagtccaagtggctggacatgctcaacaactgggacaaatggatggccaagaagcacaaaaagattcgtctgcggtgccaaaagggcatcccgccttctctgcggggccgtgcttggcagtacctgtcaggaggcaaggtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgccttctcccgaaccttgccctggagctctgtgctgcgtgtctgggacatgttcttctgtgaaggggtcaagatcatcttccgggtggggctggtgctgctgaagcacgcgctgggctcccctgagaaggtcaaagcctgccagggccagtacgagaccatcgagcgactgcggagcctcagccccaagatcatgcaggaggcctttctggtccaggaggtggtggagttgcccgtgacagagcgccagattgagcgcgaacacctcattcagctgcggcgctggcaggagacccgggagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatggttccccagtgacctcctgctgaccagctcctcgggggagctgtggaggatggtgcgcatcggtggacagcccctgggctttgatgaatgtggcatcgtggcacagattgcaggtcccctggctgccgctgacatctctgcctactacatcagcaccttcaacttcgaccacgccctgggtgcccgaggacggtatcggcagcgtcatcgaggtcctccagcggcggcaggaaggcctggcttcctgaggcccatgggcaacagagcagcctccctgctctcccctcgacccaggcttccaaagacttctctaagctatttccttaagctctggaacgagccccctgttctgctggggaccctcgttccgctctctgtatgtaagctgcgtgcaggcaccggcttttacgcggacacctgtgtacactcacaggtggagtgggcaggtgctagcctgactgcgtgtctgcccatgcaggggaacacggtgctcggggcttaagcccccaacccatcactccctgcgcagcctcggcgtttgcacagtccctgcctgaggcctgagccattccccaaaggcttcctgggccagctgcccccctgacctccgttctgcctctggtggggttgccttccctggccaggtgagtcctgacagtgcctctccctcctggggcctccaaggaaagtattttgacatctctctctcttctgtttttattgacttgttaataaaggactttgtagtga

SEQ ID NO: 454707 - DNA, 1892 bp, Homo sapiens
aggcgccgcgcgtgggcggggcgtcggcggcagcagggcggctgaggtggccgctggagctcaggcggcgggcgcggctgggatggcgaagagcaacggagagaatgggccgcgcgcgcccgcggccggggaaagcctgtcgggaacccgggagagcctggcccagggccccgacgccgcaaccaccgacgaactcagctctctcgggtctgactcggaggccaacggcttcgccgagcgccgcatcgacaagttcggcttcatcgtgggctcgcagggcgccgagggcgcattcgtctgcggtgccaaaagggcatcccgccttctctgcggggccgtgcttggcagtacctgtcaggaggcaaggtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgccttctcccgaaccttgccctggagctctgtgctgcgtgtctgggacatgttcttctgtgaaggggtcaagatcatcttccgggtggggctggtgctgctgaagcacgcgctgggctcccctgagaaggtcaaagcctgccagggccagtacgagaccatcgagcgactgcggagcctcagccccaagatcatgcaggaggcctttctggtccaggaggtggtggagttgcccgtgacagagcgccagattgagcgcgaacacctcattcagctgcggcgctggcaggagacccggggtgagctgcagtgccgctccccgcccaggctgcatggtgccaaggctatcttggatgcagaacctggtccccggcctgccctacaaccttcaccatccatccgcctgcccctagatgcccccctccctggctccaaagccaagcccaagccacccaagcaggcccagaaggagcagcggaaacagatgaaggggagagggcagctggagaagcccccagccccaaatcaagccatggtggtggccgctgcaggagatgcatgtcccccacagcatgtgcccccgaaggactcagcccccaaggactcagcccctcaggatttggctccccaggtctcagcccaccaccgctcccaggagagcttgacgtcccaagagagtgaggacacctacttgtaaccctggcagctaaggcctccagggcggggtctccatataactacacggttcatgaactgacattccacatcctgcccaccctctgagggccaagctgcctggccactgggctgggctggagtctggctggtccaacacagattctgcctggtccaacacagattctgcctgagcctccttatttattttctttacagtggcactcaggctggcccagccagggcaggcagaagctagggcctggggggtggggcctccttcagccccctcctcctgggggatgctccccagggttagggtgctggtgtgaggggaaagggtggggtgttctttgtgtaaaatagaaacatggttttgtacagaaataaacagccttgtataga

SEQ ID NO: 454708 - DNA, 1282 bp, Homo sapiens
aggcgccgcgcgtgggcggggcgtcggcggcagcagggcggctgaggtggccgctggagctcaggcggcgggcgcggctgggatggcgaagagcaacggagagaatgggccgcgcgcgcccgcggccggggaaagcctgtcgggaacccgggagagcctggcccagggccccgacgccgcaaccaccgacgaactcagctctctcgggtctgactcggaggccaacggcttcgccgagcgccgcatcgacaagttcggcttcatcgtgggctcgcagggcgccgagggcgcgctggaggaagtacccctggaggtgctgaggcagagggagtccaagtggctggacatgctcaacaactgggacaaatggatggccaagaagcacaaaaagattcgtctgcggtgccaaaagggcatcccgccttctctgcggggccgtgcttggcagtacctgtcaggaggcaaggtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgcctccagggcggggtctccatataactacacggttcatgaactgacattccacatcctgcccaccctctgagggccaagctgcctggccactgggctgggctggagtctggctggtccaacacagattctgcctggtccaacacagattctgcctgagcctccttatttattttctttacagtggcactcaggctggcccagccagggcaggcagaagctagggcctggggggtggggcctccttcagccccctcctcctgggggatgctccccagggttagggtgctggtgtgaggggaaagggtggggtgttctttgtgtaaaatagaaacatggttttgtacagaaataaacagccttgtataga

SEQ ID NO: 454709 - DNA, 1659 bp, Homo sapiens
aagcttggcacgaggctggaagaattcgcggcctgggtctagttggcggcggggtcgggtccgcgcgagccgcgatggagctgcacatcctagaacaccgggtgcgggtgctgagcgtcgcccgtcccggtctctggctctacacccacccgctcatcaagctgctcttcctgccccgccgcagccggtgcgcgcccgggttcgggagcgcagataggggctgggggctctgctctcgctccgggccagggtcggaggattaggatcgccgtaaggcaggtgcaagttcttcagcctgacggagacccctgaggattacacgcttatggtggacgaggagggctttaaagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacagcacccccaaggaggcagcctctagcagtcctgaacccagctccatcacgttctttgccttctccctcatcgagggttatatctccattgtcatggatgctgaaacacagaaaaagttccccagtgacctcctgctgaccagctcctcgggggagctgtggaggatggtgcgcatcggtggacagcccctgggctttgatgaatgtggcatcgtggcacagattgcaggtcccctggctgccgctgacatctctgcctactacatcagcaccttcaacttcgaccacgccctgggtgcccgaggacggtatcggcagcgtcatcgaggtcctccagcggcggcaggaaggcctggcttcctgaggcccatgggcaacagagcagcctccctgctctcccctcgacccaggcttccaaagacttctctaagctatttccttaagctctggaacgagccccctgttctgctggggaccctcgttccgctctctgtatgtaagctgcgtgcaggcaccggcttttacgcggacacctgtgtacactcacaggtggagtgggcaggtgctagcctgactgcgtgtctgcccatgcaggggaacacggtgctcggggcttaagcccccaacccatcactccctgcgcagcctcggcgtttgcacagtccctgcctgaggcctgagccattccccaaaggcttcctgggccagctgcccccctgacctccgttctgcctctggtggggttgccttccctggccaggtgagtcctgacagtgcctctccctcctggggcctccaaggaaagtattttgacatctctctctcttctgtttttattgacttgttaataaaggactttgtagtga

SEQ ID NO: 454710 - DNA, 1496 bp, Homo sapiens
aagcttggcacgaggctggaagaattcgcggcctgggtctagttggcggcggggtcgggtccgcgcgagccgcgatggagctgcacatcctagaacaccgggtgcgggtgctgagcgtcgcccgtcccggtctctggctctacacccacccgctcatcaagctgctcttcctgccccgccgcagccgagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacagcacccccaaggaggcagcctctagcagtcctgaacccagctccatcacgttctttgccttctccctcatcgagggttatatctccattgtcatggatgctgaaacacagaaaaagttccccagtgacctcctgctgaccagctcctcgggggagctgtggaggatggtgcgcatcggtggacagcccctgggctttgatgaatgtggcatcgtggcacagattgcaggtcccctggctgccgctgacatctctgcctactacatcagcaccttcaacttcgaccacgccctgggtgcccgaggacggtatcggcagcgtcatcgaggtcctccagcggcggcaggaaggcctggcttcctgaggcccatgggcaacagagcagcctccctgctctcccctcgacccaggcttccaaagacttctctaagctatttccttaagctctggaacgagccccctgttctgctggggaccctcgttccgctctctgtatgtaagctgcgtgcaggcaccggcttttacgcggacacctgtgtacactcacaggtggagtgggcaggtgctagcctgactgcgtgtctgcccatgcaggggaacacggtgctcggggcttaagcccccaacccatcactccctgcgcagcctcggcgtttgcacagtccctgcctgaggcctgagccattccccaaaggcttcctgggccagctgcccccctgacctccgttctgcctctggtggggttgccttccctggccaggtgagtcctgacagtgcctctccctcctggggcctccaaggaaagtattttgacatctctctctcttctgtttttattgacttgttaataaaggactttgtagtga

SEQ ID NO: 454711 - DNA, 1182 bp, Homo sapiens
aggcgccgcgcgtgggcggggcgtcggcggcagcagggcggctgaggtggccgctggagctcaggcggcgggcgcggctgggatggcgaagagcaacggagagaatgggccgcgcgcgcccgcggccggggaaagcctgtcgggaacccgggagagcctggcccagggccccgacgccgcaaccaccgacgaactcagctctctcgggtctgactcggaggccaacggcttcgccgagcgccgcatcgacaagttcggcttcatcgtgggctcgcagggcgccgagggcgcattcgtctgcggtgccaaaagggcatcccgccttctctgcggggccgtgcttggcagtacctgtcaggaggcaaggtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgcctccagggcggggtctccatataactacacggttcatgaactgacattccacatcctgcccaccctctgagggccaagctgcctggccactgggctgggctggagtctggctggtccaacacagattctgcctggtccaacacagattctgcctgagcctccttatttattttctttacagtggcactcaggctggcccagccagggcaggcagaagctagggcctggggggtggggcctccttcagccccctcctcctgggggatgctccccagggttagggtgctggtgtgaggggaaagggtggggtgttctttgtgtaaaatagaaacatggttttgtacagaaataaacagccttgtataga

SEQ ID NO: 454712 - DNA, 2195 bp, Homo sapiens
atgaccttgccagcatggaggataaaacagagaaatggtcttcccagcctgaaggtccacttaaattgaaagcttcaagtactgatatgccatcccagatttctgtggttaatgtggatcaactgtgggaagattctgtcctaactgtcaaattccccaaattaatggtaccaaggttctccttcgctgcccccagctcagaggatgatgtgttcatccccactgtgagggaagtgcagtgtccagaggccaatattgatacagccctttgtaaggaaagtccggggctctggggagccagcatcctgaaggcaggtgctggggtccctggggagcagcctgtggaccttaacctgcctttggaagctcccccaatttcaaaggtcagagtgcatattcagggtgctcaggttgaaagtcaagaggtcactatacacagcatagtgacaccagagtttgtagatctctcagtacccaggactttttccactcagattgtgcgggaatcagagatccccacgtcagagattcaaacaccttcgtacggattttccttattaaaagtgaaaatcccagagccccacacgcaggctagagtgtacacaacaatgactcaacactctaggactcaggagggcacagaagaggctcccatacaagccaccccaggagtagactccatttctggagatctccagcctgacactggagaaccatttgagatgatctcttccagcgtcaatgtactgggacagcaaacactcacatttgaagttccttctggccaccagcttgcagacagctgttcagatgaggagccagcagaaattcttgagtttccccctgatgatagccaagaggcaaccacaccactggcagatgaaggcagggctccaaaagacaaaccagaaagtaaaaaatctggtctgctctggttttggcttccaaacattgggttttcctcttctgttgatgagacaggtgttgattccaaaaatgacgtccagagatctgctcccattcaaacacagcctgaggcacgaccagaggcagaactgcctaaaaaacaggagaaggcaggctggttccgatttcccaaattagggttctcctcatctcctaccaagaaaagcaaaagcaccgaagatggggcagagctggaagaacaaaaacttcaagaagaaacaatcacgttttttgatgcccgagaaagtttctcccctgaagagaaggaagagggtgaactgatcgggcctgtgggcactgggctggactccagagtgatggtgacatccgcggcaagaacagagttaatcctgcccgagcaggacagaaaagctgacgatgaaagcaaagggtcaggcctgggaccaaatgaaggctgagaggtatggctcatcggtacaagagagatgcaaaaaactaagttggaaagtaaaggctacacacacatatggagcaccccatcccacagcacattacatccacctcacttcacagaacggagaacagagcagaaatgaccagaacacctttgtcaccatcacacagccctcctaaaatggaaccaaagcttcccagctccctcaaagctttggatgcaaagaaggcaccctgacttccacaagacaccagaattcacacggtactcagaggcactgctggggaagtttgttggtctttattagataaatttccagagacctgtccataatacccaacagaacatgactgtttctttgaggaaagggttataatgtctgtggtgtacaagtcgtttttggtataacttctttcctgctgctgctgcttcccggcaaacatagttttcctatttcaggcagagtgcggtatattccaggaaacactgtttcctactcacttagcttacttctttgttgaatgcctcactaatggcaagtttcaagatgttttgggtgacaatgcacacatgctgggcaaaagggtgatggccagtggctggcagctgggccagcagaagctaggacatctgtgagttgtcattctcatctatccatgtccactggcctgccagcatccgccagtgccttgccagtgtgcacggtcccacactgtggcccctgagtcccctaatgtacacgctgcagccagaatgcagatggagctggcttggctgttccctggatgggcaataaagaaagtgctgcatccca

SEQ ID NO: 454713 - DNA, 821 bp, Homo sapiens
atgaccttgccagcatggaggataaaacagagaaatggtcttcccagcctgaaggtccacttaaattgaaagcttcaagtactgatatgccatcccagatttctgtggttaatgtggatcaactgtgggaagattctgtcctaactgtcaaattccccaaattaatggtaccaaggttctccttcgctgcccccagctcagaggatgatgtgttcatccccactgtgagggaagtgcagtgtccagaggccaatattgatacagccctttgtaaggaaagtccggggctctggggagccagcatcctgaaggcaggtgctggggtccctggggagcagcctgtggaccttaacctgcctttggaagctcccccaatttcaaaggtcagagtgcatattcagggtgctcaggttgaaagtcaagaggtcactatacacagcatagtgacaccagagtttgtagatctctcagtacccaggactttttccactcagattgtgcgggaatcagagatccccacgtcagagattcaaacaccttcgtacggattttccttattaaaagtgaaaatcccagagccccacacgcaggctagagtgtacacaacaatgactcaacactctaggactcaggagggcacagaagaggctcccatacaagccaccccaggagtagactccatttctggagatctccagcctgacactggagaaccatttgagatgatctcttccagcgtcaatgtactgggaagccggtggccagaaggaacttcaaatgtgagtgtttgctgtcccagtacattgacgctggaagagatc

SEQ ID NO: 454714 - DNA, 1031 bp, Homo sapiens
  misc_feature (62)..(62): n is a, c, g, or t
  misc_feature (64)..(64): n is a, c, g, or t
caaccaaacccaatggcaaggaacacaattcgagaaacatccgtttggagccggaagtttcncngaaagaagagggtgaactgatcgggcctgtgggcactgggctggactccagagtgatggtgacatccgcggcaagaacagagttaatcctgcccgagcaggacagaaaagctgacgatgaaagcaaagggtcaggcctgggaccaaatgaaggctgagaggtatggctcatcggtacaagagagatgcaaaaaactaagttggaaagtaaaggctacacacacatatggagcaccccatcccacagcacattacatccacctcacttcacagaacggagaacagagcagaaatgaccagaacacctttgtcaccatcacacagccctcctaaaatggaaccaaagcttcccagctccctcaaagctttggatgcaaagaaggcaccctgacttccacaagacaccagaattcacacggtactcagaggcactgctggggaagtttgttggtctttattagataaatttccagagacctgtccataatacccaacagaacatgactgtttctttgaggaaagggttataatgtctgtggtgtacaagtcgtttttggtataacttctttcctgctgctgctgcttcccggcaaacatagttttcctatttcaggcagagtgcggtatattccaggaaacactgtttcctactcacttagcttacttctttgttgaatgcctcactaatggcaagtttcaagatgttttgggtgacaatgcacacatgctgggcaaaagggtgatggccagtggctggcagctgggccagcagaagctaggacatctgtgagttgtcattctcatctatccatgtccactggcctgccagcatccgccagtgccttgccagtgtgcacggtcccacactgtggcccctgagtcccctaatgtacacgctgcagccagaatgcagatggagctggcttggctgttccctggatgggcaataaagaaagtgctgcatccca

SEQ ID NO: 454715 - DNA, 2620 bp, Homo sapiens
atgaccttgccagcatggaggataaaacagagaaatggtcttcccagcctgaaggtccacttaaattgaaagcttcaagtactgatatgccatcccagatttctgtggttaatgtggatcaactgtgggaagattctgtcctaactgtcaaattccccaaattaatggtaccaaggttctccttcgctgcccccagctcagaggatgatgtgttcatccccactgtgagggaagtgcagtgtccagaggccaatattgatacagccctttgtaaggaaagtccggggctctggggagccagcatcctgaaggcaggtgctggggtccctggggagcagcctgtggaccttaacctgcctttggaagctcccccaatttcaaaggtcagagtgcatattcagggtgctcaggttgaaagtcaagaggtcactatacacagcatagtgacaccagagtttgtagatctctcagtacccaggactttttccactcagattgtgcgggaatcagagatccccacgtcagagattcaaacaccttcgtacggattttccttattaaaagtgaaaatcccagagccccacacgcaggctagagtgtacacaacaatgactcaacactctaggactcaggagggcacagaagaggctcccatacaagccaccccaggagtagactccatttctggagatctccagcctgacactggagaaccatttgagatgatctcttccagcgtcaatgtactgggacagcaaacactcacatttgaagttccttctggccaccagcttgcagacagctgttcagatgaggagccagcagaaattcttgagtttccccctgatgatagccaagaggcaaccacaccactggcagatgaaggcagggctccaaaagacaaaccagaaagtaaaaaatctggtctgctctggttttggcttccaaacattgggttttcctcttctgttgatgagacaggtgttgattccaaaaatgacgtccagagatctgctcccattcaaacacagcctgaggcacgaccagaggcagaactgcctaaaaaacaggagaaggcaggctggttccgatttcccaaattagggttctcctcatctcctaccaagaaaagcaaaagcaccgaagatggggcagagctggaagaacaaaaacttcaagaagaaacaatcacgttttttgatgcccgagaaagtttctcccctgaagagaaggaagagggtgaactgatcgggcctgtgggcactgggctggactccagagtgatggtgacatccgcggcaagaacagagttaatcctgcccgagcaggacagaaaagctgacgatgaaagcaaagggtcaggcctgggaccaaatgaaggctgagaggtatggctcatcggtacaagagagatgcaaaaaactaagttggaaagtaaaggctacacacacatatggagcaccccatcccacagcacattacatccacctcacttcacagaacggagaacagagcagaaatgaccagaacacctttgtcaccatcacacagccctcctaaaatggaaccaaagcttcccagctccctcaaagctttggatgcaaagaaggcaccctgacttccacaagacaccagaattcacacggtactcagaggcactgctggggaagtttgttggtctttattagataaatttccagagacctgtccataatacccaacagaacatgactgtttctttgaggaaagggttataatgtctgtggtgtacaagtcgtttttggtataacttctttcctgctgctgctgcttcccggcaaacatagttttcctatttcaggcagagtgcggtatattccaggaaacactgtttcctactcacttagcttacttctttgttgaatgcctcactaatggcaagtttcaagatgttttgggtgacaatgcacacatgctgggcaaaagggtgatggccagtggctggcagctgggccagcagaagctaggacatctgtgagttgtcattctcatctatccatgtccactggcctgccagcatccgccagtgccttgccagtgtgcacggtcccacactgtggcccctgagtcccctaatgtacacgctgcagccagaatgcagatggagctggcttggctgttccctggatgggcaataaagaaagtgctgcatcccaaaaaaaaaaaaaaaaaaaaaaaaaaaaaaaaaaaaaaaatataacaaatcaacaaaacaaaaaaacaaaagaaacaacaaaaagaaagggggggggggccacaaaagaatctctcccggggggggcgccattctgcgcgaacccacaattttgtgacaaagaggggcgctccaatatgagggcagcgctcatttacaacacacgctgcagcgggtggcccaccagtacaaaaagacgagtaccggacgccggcaaacaccttcaacccctggcgcgacacatcgtgggcaggagccccccccttcatggcgggggggggcggagcaacaaccatcagcggacgcacacaccccaccaccacaaagacattgatcacccactcctgagagaggacacacaacacacaccctccgagaggtgatcgt

SEQ ID NO: 454716 - DNA, 1117 bp, Homo sapiens
ccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggcggcatgcgcctggggtcccaagtactcgggaggtagaggagagaaaaatcacttgagcccagagaggtcaaggctacagggagctgagatcgcatcactgtactccagctggggtgaaacggcgagactctacctcaaaaataaataaatacatacataattaataaataaaacatcaaagaccagccgacctaactccatctaaaatacacaacttctacgcaaaatataaataaaattagaaaacaaactacaatctcagaaaagcactagcaacttagacgacatactaaaggccaaaaataccctcctgacacacagctaataaagaaaaagtcaactattccagttaaaaagaagaaaaggaaactggctgtggtggcttatgcctgtaatcccagtgctttgggaaggccaggagtttgagaccaggatggacagcatagcaagaccccatctctacaaggaaaaaaagaatcagccaggcatggtggtgtggagctgtagttccaactactcggggggctgaggaggaaggatcgcttgagccagggaggtagaggctgcagtgagctatgattgtgccactgcagtccagcctgggcgacagagcaagacccggtctcgaaagaaaagaaagagaaagcaagaaaagaaagatggctgggcacggtggctcactcctgtaatcccagaactttgggaggccaaggtgggtggatcatgagatcaagagatcaagaccatcctggccaacagggtgaaaccccgtctctactaaaaatgcaaaaattagctgggcgtggtggcgggcaccagtccaggctactcgggaggctgaggcaggagaatggtgtgaacccaggaggcggagcttgcagtgagccgagatggcactgctgcactccagcctgggcaacagagtgagactccatctcaaataataat

SEQ ID NO: 454717 - DNA, 2258 bp, Homo sapiens
tacgggttcactcgcatagtgctgtttatgcttcatccatgagcccaccgatagcagagcaaatcatcagatcactaaaacttatcatgggactggatgggaccactcaagggctgcagagagtacagcaacttgcgaaaaacacaagatacttcagacaaagactgcaggaaatgggattcattatctatggcaatgagaatgcttctgttgttcctctgcttctttatatgcctggtaaagtagcggcttttgcaaggcatatgctagagaaaaaaattggagtggtggtcgtgggatttccagccactcccctcgcagaagctcgggctcggttttgtgtttcagcggcacatacccgggagatgttagacacggttttagaagctcttgatgaaatgggtgatctcttgcaactgaaatattcccggcacaagaagtcagcacgtcctgagctctatgatgagacgagctttgaactcgaagattaagtttcctggtcctgaatgacacataaagactttgcgagaaagacctccctccttgcctcacaaggaatataaatggatttctcccccttcctcaggacaattttggttcccagaccagcttgattgaactgagggagacgttgttgtttttaatgtctccagcttggactgcagagacaaaaacatgattccagatttaagtctctcttcttccaagtattctactagaaatacacacacacacacacacacacttctgagaatatttttaatggcaataagcctgtgttttagctgctactgtgcagaccctttcagggattccaaccaaatgcaaatgagagaatttaaaatttttattcagtaagttcactatgtgtttacttattccatctgcagatgtaagtgagtgtggtggacagtagccaccttccttgttccactcataaaagcatcagctagatctcatctgtatcatgggaagttccaggcaggagggtaaagaaatgttgtttctaccatttgtcacatttggacgtttttcacagacaagtgtcaaaagacatagttaatgtttcgagggggaaagcagaactgatcaactgcgactagagacgtctttgaaggaaattttccttttcctcttgctggtctcctacagttttacagctgagcttttgaggtttggaaaattcaagatgtttgtttcataagaaaaggggcagaaagcaagcacaagacacttttaggtctagactaaaatggtagttacaacaatttgaaccttgttggtgcagtgcacggttgaatgcttaccctgcacagcctctattaccttaaggaattagttgtcattttcctattgaattttgagtaaatggtgaaattcagtgtcctttagaatcgactcccaagactatatttgaagaatgcattgattcaagaaggacatttaaaagcaaattctgactttttcaagaccaacacacttgtttaggcctattaaattgtactatcacttgttacatgccctctgaattgggagaaagtgggcttgcacactttgaggtaactaactgtaatttacttgtgttctctctttcttgctctccttctcaacatgaacacaaacctctatggaaaagtagcctcttgttaatctgatctagtttgtatggaaaaagcccatggagaaccttatctttaacaagctcccagagggtgcccagatttggaaattctagagagcagtggtgaccttttagcaaagcttctgtaacagttcgaatgagttgcagaacattccactccatcaaatgacactgtaaacaaatcacttcaagagaggcttggttttgtgtggcacagatggacccaagctttcatgctgtgcactgagatagaaactccacccgcagcgcctgcgatggatggagcagtgtgccctgatgctcaaagcgtattaaaggaaaaaaagtgatcagcatggaaagtttttatggggaaattataactccaagtgggtgcattggtttaaaaatggatcacaatgatagagttcttcatgaatgtttacaagttgtaaggaataccgttagtgaaagaggaaaagaagtgggttctgaaaatgcagtttcccatccaatgattttgataacaaaattccaacttttctcaatgaaactgatgcagtattatttgtgcaaataatactgcatcagtttcatttgtgcaaataaaatgtgtcataaatatgcaaaaaaaaaa

SEQ ID NO: 454718 - DNA, 2695 bp, Homo sapiens
tacgggttcactcgcatagtgctgtttatgcttcatccatgagcccaccgatagcagagcaaatcatcagatcactaaaacttatcatgggactggatgggaccactcaagggctgcagagagtacagcaacttgcgaaaaacacaagatacttcagacaaagactgcaggaaatgggattcattatctatggcaatgagaatgcttctgttgttcctctgcttctttatatgcctggtaaagtagcggcttttgcaaggcatatgctagagaaaaaaattggagtggtggtcgtgggatttccagccactcccctcgcagaagctcgggctcggttttgtgtttcagcggcacatacccgggagatgttagacacggttttagaagctcttgatgaaatgggtgatctcttgcaactgaaatattcccggcacaagaagtcagcacgtcctgagctctatgatgagacgagctttgaactcgaagattaagtttcctggtcctgaatgacacataaagactttgcgagaaagacctccctccttgcctcacaaggaatataaatggatttctcccccttcctcaggacaattttggttcccagaccagcttgattgaactgagggagacgttgttgtttttaatgtctccagcttggactgcagagacaaaaacatgattccagatttaagtctctcttcttccaagtattctactagaaatacacacacacacacacacacacttctgagaatatttttaatggcaataagcctgtgttttagctgctactgtgcagaccctttcagggattccaaccaaatgcaaatgagagaatttaaaatttttattcagtaagttcactatgtgtttacttattccatctgcagatgtaagtgagtgtggtggacagtagccaccttccttgttccactcataaaagcatcagctagatctcatctgtatcatgggaagttccaggcaggagggtaaagaaatgttgtttctaccatttgtcacatttggacgtttttcacagacaagtgtcaaaagacatagttaatgtttcgagggggaaagcagaactgatcaactgcgactagagacgtctttgaaggaaattttccttttcctcttgctggtctcctacagttttacagctgagcttttgaggtttggaaaattcaagatgtttgtttcataagaaaaggggcagaaagcaagcacaagacacttttaggtctagactaaaatggtagttacaacaatttgaaccttgttggtgcagtgcacggttgaatgcttaccctgcacagcctctattaccttaaggaattagttgtcattttcctattgaattttgagtaaatggtgaaattcagtgtcctttagaatcgactcccaagactatatttgaagaatgcattgattcaagaaggacatttaaaagcaaattctgactttttcaagaccaacacacttgtttaggcctattaaattgtactatcacttgttacatgccctctgaattgggagaaagtgggcttgcacactttgaggtaactaactgtaatttacttgtgttctctctttcttgctctccttctcaacatgaacacaaacctctatggaaaagtagcctcttgttaatctgatctagtttgtatggaaaaagcccatggagaaccttatctttaacaagctcccagagggtgcccagatttggaaattctagagagcagtggtgaccttttagcaaagcttctgtaacagttcgaatgagttgcagaacattccactccatcaaatgacactgtaaacaaatcacttcaagagaggcttggttttgtgtggcacagatggacccaagctttcatgctgtgcactgagatagaaactccacccgcagcgcctgcgatggatggagcagtgtgccctgatgctcaaagcgtattaaaggaaaaaaagtgatcagcatggaaagtttttatggggaaattataactccaagtgggtgcattggtttaaaaatggatcacaatgatagagttcttcatgaatgtttacaagttgtaaggaataccgttagtgaaagaggaaaagaagtgggttctgaaaatgcagtttcccatccaatgattttgataacaaaattccaacttttctcaatgaaactgatgcagtattatttgtgcaaataaaatgtgtcataaatatgcaaagaaagggagacatactgttcttatcttgaatatgtgcatttaaatgaattgtccaaaatgcataaatgccttgcgttctataaaggaaacaggaggtcaaaaagacagcgagatatctagtccttccacaaggtatggaaagcaataaacatcttcctttctttctgaaaaaaaaaaaaaaaaaaaaaaaaaaaaaaaatttgtggggggcttgggcctttgaaaaagtttttaaaaacatttggatggggccgccggggccccaaagcggcaagggcatcactggggccaacggtgtcccagaggaaacccggggcgagagaaaaggacgcggaggttctccaccaataaaaacgccgcgggggaaaaccgaggctcttcgcaaacaatcccaaaggggagccgaggggcacaaaagggcgctaacaacaagggggcacaagaaacgccaaatcaaataagccggcgggggt

SEQ ID NO: 454719 - DNA, 295 bp, Homo sapiens
gcggccgcctactactactactgctcgaattcaagcttctaacgatgtacggggacatgctatgaagatcacctatgccaagaaataacatttgggatagtcgtctttaaaagacttggtgttatttacagtgtttgttttgataacatttggctgggtcattttaatagttagagatgaggaggagtaaaagtgaaatttttgtgaaggacttaaattatccagtgtttctttagccttggtgaactatgaaatacgaaggccttaattttgtacaataaacttttatttgtat

SEQ ID NO: 454720 - DNA, 1675 bp, Homo sapiens
ttgaggagcgtggctacgttgcttccggtgcctggctccgtttcctgcttttggttcttacagtagtcggcgtaggccttaggtgggttcgtgcgccttctacctcgctgtttcggttttcctggctcctcggcccttttctcccctgttgcagctgggagcggacgaagcgcgaagctgggattttttactgtctcctgaagaatttaacacaaacatggatatcagaccaaatcatacaatttatatcaacaatatgaatgacaaaattaaaaaggaagaattgaagagatccctatatgccctgttttctcagtttggtcatgtggtggacattgtggctttaaagaccatgaagatgagggggcaggcctttgtcatatttaaggaactgggctcatccacaaatgccttgagacagctacaaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagactgcaacaaccacaaacaaaaagcctggccagggaactccaaattcagctaatacccaaggaaattcaacaccaaatcctcaggtccctgattaccctccaaactatattttattccttaataacttaccagaagagactaatgagatgatgttatccatgctgtttaatcagttccctggcttcaaggaagtacgtctggtaccagggaggcatgacattgcttttgttgaatttgaaaatgatgggcaggctggagctgccagggatgctttacagggatttaagatcacaccgtcccatgctatgaagatcacctatgccaagaaataacatttgggatagtcgtctttaaaagacttggtgttatttacagtgtttgttttgataacatttggctgggtcattttaatagttagagatgaggaggagtaaaagtgaaatttttgtgaaggacttaaattatccagtgtttctttagccttggtgaactatgaaatacgaaggccttaattttgtacaataaacttttatttgtattctgtgtatataatgctttcttgattgacccatctccctatcatcaaatgacttctagtctagaacacacttaaggtttataaacttgtgtaataggatgcttttctagtgttactttggaggagctaattatacaacatcattgaaccattcaataaaagttaagtaaaattagatcacagaagctagtagatgactgttgtattaatggtaacaatgattgttctgggtattagaagaaaatgagaccccaggcaggatcctaaatttgatctttgtatccttttaagaaatgaatatattattttgctgctagtagggattccacaagttttcttcattcagtattaaataaaggctgttcttactgtttactgagaaaacagaaagggaatgctatcttcacactttgcatttaatgctgtttccttcatgaggcaggactgttctaaggttaatatgcaatctctttattgaaagacctccagggtaaaaattttttgatctatagtctcttttcccccttaagacaaatagactgattaataaagagttgccagtgctaaaaaaata

SEQ ID NO: 454721 - DNA, 1236 bp, Homo sapiens
ttgaggagcgtggctacgttgcttccggtgcctggctccgtttcctgcttttggttcttacagtagtcggcgtaggccttaggtgggttcgtgcgccttctacctcgctgtttcggttttcctggctcctcggcccttttctcccctgttgcagctgggagcggacgaagcgcgaagctgggattttttactgtctcctgaagaatttaacacaaacatggatatcagaccaaatcatacaatttatatcaacaatatgaatgacaaaattaaaaaggaagaattgaagagatccctatatgccctgttttctcagtttggtcatgtggtggacattgtggctttaaagaccatgaagatgagggggcaggcctttgtcatatttaaggaactgggctcatccacaaatgccttgagacagctacaaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagactgcaacaaccacaaacaaaaagcctggccagggaactccaaattcagctaatacccaaggaaattcaacaccaaatcctcaggtccctgattaccctccaaactatattttattccttaataacttaccagaagagactaatgagatgatgttatccatgctgtttaatcagttccctggcttcaaggaagtacgtctggtaccagggaggcatgacattgcttttgttgaatttgaaaatgatgggcaggctggagctgccagggatgctttacagggatttaagatcacaccgtcccatgctatgaagatcacctatgccaagaaataacatttgggatagtcgtctttaaaagacttggtgttatttacagtgtttgttttgataacatttggctgggtcattttaatagttagagatgaggaggagtaaaagtgaaatttttgtgaaggacttaaattatccagtgtttctttagccttggtgaactatgaaatacgaaggccttaattttgtacaataaacttttatttgtataaaaaaaaaaaaaaaaaaacaaaaaaaagggggggaggttaaaaagattctaagagggggcaaaagttagggttacccaggttcttggacaaaggggggccaaaaaggaggagaattaaaaggaaggaatgtgg

SEQ ID NO: 454722 - DNA, 1644 bp, Homo sapiens
tggacttcgttagggggccttgggcgaaggtgcttgtgtctggagaggcgggaggcttgcgcgtacgaagtaaaggatagttaatgtcagtctgctcgtgcgaggcgtggacaacggtcgacgtgcgcgttcagattggatacactagtctccatgaagaattgaacgacataacatggatcatcatagaccagatctatcacaattttaatatcatcatcatatgaatgcacacagaatctagaaaggaaattgaagagatccctatatgccctgttttctcagtttggtcatgtggtggacattgtggctttaaagaccatgaagatgagggggcaggcctttgtcatatttaaggaactgggctcatccacaaatgccttgagacagctacaaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagactgcaacaaccacaaacaaaaagcctggccagggaactccaaattcagctaatacccaaggaaattcaacaccaaatcctcaggtccctgattaccctccaaactatattttattccttaataacttaccagaagagactaatgagatgatgttatccatgctgtttaatcagttccctggcttcaaggaagtacgtctggtaccagggaggcatgacattgcttttgttgaatttgaaaatgatgggcaggctggagctgccagggatgctttacagggatttaagatcacaccgtcccatgctatgaagatcacctatgccaagaaataacatttgggatagtcgtctttaaaagacttggtgttatttacagtgtttgttttgataacatttggctgggtcattttaatagttagagatgaggaggagtaaaagtgaaatttttgtgaaggacttaaattatccagtgtttctttagccttggtgaactatgaaatacgaaggccttaattttgtacaataaacttttatttgtattctgtgtatataatgctttcttgattgacccatctccctatcatcaaatgacttctagtctagaacacacttaaggtttataaacttgtgtaataggatgcttttctagtgttactttggaggagctaattatacaacatcattgaaccattcaataaaagttaagtaaaattagatcacagaagctagtagatgactgttgtattaatggtaacaatgattgttctgggtattagaagaaaatgagaccccaggcaggatcctaaatttgatctttgtatccttttaagaaatgaatatattattttgctgctagtagggattccacaagttttcttcattcagtattaaataaaggctgttcttactgtttactgagaaaacagaaagggaatgctatcttcacactttgcatttaatgctgtttccttcatgaggcaggactgttctaaggttaatatgcaatctctttattgaaagacctccagggtaaaaattttttgatctatagtctcttttcccccttaagacaaatagactgattaataaagagttgccagtgctaaaaaaata

SEQ ID NO: 454723 - DNA, 1379 bp, Homo sapiens
gcggccgcctactactactactgctcgaattcaagcttctaacgatgtacggggacatgaagatgagggggcaggcctttgtcatatttaaggaactgggctcatccacaaatgccttgagacagctacaaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagactgcaacaaccacaaacaaaaagcctggccagggaactccaaattcagctaatacccaaggaaattcaacaccaaatcctcaggtccctgattaccctccaaactatattttattccttaataacttaccagaagagactaatgagatgatgttatccatgctgtttaatcagttccctggcttcaaggaagtacgtctggtaccagggaggcatgacattgcttttgttgaatttgaaaatgatgggcaggctggagctgccagggatgctttacagggatttaagatcacaccgtcccatgctatgaagatcacctatgccaagaaataacatttgggatagtcgtctttaaaagacttggtgttatttacagtgtttgttttgataacatttggctgggtcattttaatagttagagatgaggaggagtaaaagtgaaatttttgtgaaggacttaaattatccagtgtttctttagccttggtgaactatgaaatacgaaggccttaattttgtacaataaacttttatttgtattctgtgtatataatgctttcttgattgacccatctccctatcatcaaatgacttctagtctagaacacacttaaggtttataaacttgtgtaataggatgcttttctagtgttactttggaggagctaattatacaacatcattgaaccattcaataaaagttaagtaaaattagatcacagaagctagtagatgactgttgtattaatggtaacaatgattgttctgggtattagaagaaaatgagaccccaggcaggatcctaaatttgatctttgtatccttttaagaaatgaatatattattttgctgctagtagggattccacaagttttcttcattcagtattaaataaaggctgttcttactgtttactgagaaaacagaaagggaatgctatcttcacactttgcatttaatgctgtttccttcatgaggcaggactgttctaaggttaatatgcaatctctttattgaaagacctccagggtaaaaattttttgatctatagtctcttttcccccttaagacaaatagactgattaataaagagttgccagtgctaaaaaaata

SEQ ID NO: 454724 - DNA, 1535 bp, Homo sapiens
ttgaggagcgtggctacgttgcttccggtgcctggctccgtttcctgcttttggttcttacagtagtcggcgtaggccttaggtgggttcgtgcgccttctacctcgctgtttcggttttcctggctcctcggcccttttctcccctgttgcagctgggagcggacgaagcgcgaagctgggattttttactgtctcctgaagaatttaacacaaacatggatatcagaccaaatcatacaatttatatcaacaatatgaatgacaaaattaaaaaggaagaattgaagagatccctatatgccctgttttctcagtttggtcatgtggtggacattgtggctttaaagaccatgaagatgagggggcaggcctttgtcatatttaaggaactgggctcatccacaaatgccttgagacagctacaaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagactgcaacaaccacaaacaaaaagcctggccaggttccctggcttcaaggaagtacgtctggtaccagggaggcatgacattgcttttgttgaatttgaaaatgatgggcaggctggagctgccagggatgctttacagggatttaagatcacaccgtcccatgctatgaagatcacctatgccaagaaataacatttgggatagtcgtctttaaaagacttggtgttatttacagtgtttgttttgataacatttggctgggtcattttaatagttagagatgaggaggagtaaaagtgaaatttttgtgaaggacttaaattatccagtgtttctttagccttggtgaactatgaaatacgaaggccttaattttgtacaataaacttttatttgtattctgtgtatataatgctttcttgattgacccatctccctatcatcaaatgacttctagtctagaacacacttaaggtttataaacttgtgtaataggatgcttttctagtgttactttggaggagctaattatacaacatcattgaaccattcaataaaagttaagtaaaattagatcacagaagctagtagatgactgttgtattaatggtaacaatgattgttctgggtattagaagaaaatgagaccccaggcaggatcctaaatttgatctttgtatccttttaagaaatgaatatattattttgctgctagtagggattccacaagttttcttcattcagtattaaataaaggctgttcttactgtttactgagaaaacagaaagggaatgctatcttcacactttgcatttaatgctgtttccttcatgaggcaggactgttctaaggttaatatgcaatctctttattgaaagacctccagggtaaaaattttttgatctatagtctcttttcccccttaagacaaatagactgattaataaagagttgccagtgctaaaaaaata

SEQ ID NO: 454725 - DNA, 962 bp, Homo sapiens
ttgaggagcgtggctacgttgcttccggtgcctggctccgtttcctgcttttggttcttacagtagtcggcgtaggccttaggtgggttcgtgcgccttctacctcgctgtttcggttttcctggctcctcggcccttttctcccctgttgcagctgggagcggacgaagcgcgaagctgggattttttactgtctcctgaagaatttaacacaaacatggatatcagaccaaatcatacaatttatatcaacaatatgaatgacaaaattaaaaaggaagaattgaagagatccctatatgccctgttttctcagtttggtcatgtggtggacattgtggctttaaagaccatgaagatgagggggcaggcctttgtcatatttaaggaactgggctcatccacaaatgccttgagacagctacaaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagactgcaacaaccacaaacaaaaagcctggccaggttccctggcttcaaggaagtacgtctggtaccagggaggcatgacattgcttttgttgaatttgaaaatgatgggcaggctggagctgccagggatgctttacagggatttaagatcacaccgtcccatgctatgaagatcacctatgccaagaaataacatttgggatagtcgtctttaaaagacttggtgttatttacagtgtttgttttgataacatttggctgggtcattttaatagttagagatgaggaggagtaaaagtgaaatttttgtgaaggacttaaattatccagtgtttctttagccttggtgaactatgaaatacgaaggccttaattttgtacaataaacttttatttgtat

SEQ ID NO: 454726 - DNA, 720 bp, Homo sapiens
ttgaggagcgtggctacgttgcttccggtgcctggctccgtttcctgcttttggttcttacagtagtcggcgtaggccttaggtgggttcgtgcgccttctacctcgctgtttcggttttcctggctcctcggcccttttctcccctgttgcagctgggagcggacgaagcgcgaagctgggattttttactgtctcctgaagaatttaacacaaacatggatatcagaccaaatcatacaatttatatcaacaatatgaatgacaaaattaaaaaggaagaattgaagagatccctatatgccctgttttctcagtttggtcatgtggtggacattgtggctttaaagaccatgaagatgagggggcaggcctttgtcatatttaaggaactgggctcatccacaaatgccttgagacagctacaaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagactgcaacaaccacaaacaaaaagcctggccagggaactccaaattcagctaatacccaaggaaattcaacaccaaatcctcaggtccctgattaccactccacactaccagggaaatagttaagtaacgaaacagaagtgaaggatgagatgaggat

SEQ ID NO: 454727 - DNA, 1432 bp, Homo sapiens
tagtatgctgggaagtagtaacagtacagaggaattgagtatctgagtgatactgagtgtggtaaccagctacggaggggtgacattgctggccatctctaattttattaagatctttgattatgttatccaggtgacaaaattctccaatcacgactcacctccagaagcttaaaacataattgtttcatatactgttaaacacttaagagatttgtaattttccagactttcaatgtctttacttgaatgtctgccttgcttagttactgtaaggttttgatttatttctccagtgtcattgtttttcagctttattgtttgatatagtaagatttcacatgcctagcttacgatgctgtttaaacttacaagctaactttgcctttttactttttaataggtccctgattaccctccaaactatattttattccttaataacttaccagaagagactaatgagatgatgttatccatgctgtttaatcagttccctggcttcaaggaagtacgtctggtaccagggaggcatgacattgcttttgttgaatttgaaaatgatgggcaggctggagctgccagggatgctttacagggatttaagatcacaccgtcccatgctatgaagatcacctatgccaagaaataacatttgggatagtcgtctttaaaagacttggtgttatttacagtgtttgttttgataacatttggctgggtcattttaatagttagagatgaggaggagtaaaagtgaaatttttgtgaaggacttaaattatccagtgtttctttagccttggtgaactatgaaatacgaaggccttaattttgtacaataaacttttatttgtattctgtgtatataatgctttcttgattgacccatctccctatcatcaaatgacttctagtctagaacacacttaaggtttataaacttgtgtaataggatgcttttctagtgttactttggaggagctaattatacaacatcattgaaccattcaataaaagttaagtaaaattagatcacagaagctagtagatgactgttgtattaatggtaacaatgattgttctgggtattagaagaaaatgagaccccaggcaggatcctaaatttgatctttgtatccttttaagaaatgaatatattattttgctgctagtagggattccacaagttttcttcattcagtattaaataaaggctgttcttactgtttactgagaaaacagaaagggaatgctatcttcacactttgcatttaatgctgtttccttcatgaggcaggactgttctaaggttaatatgcaatctctttattgaaagacctccagggtaaaaattttttgatctatagtctcttttcccccttaagacaaatagactgattaataaagagttgccagtgctaaaaaaata

SEQ ID NO: 454728 - DNA, 1148 bp, Homo sapiens
ttgatataatataaaatagaattagtttattcttgcagttcttccatggtattaattacacatgaggctcttccgtctactcagtattcttggttagagtatggttatttttcttggactagtattaggaagttgcttaacaaattttaacacaaagcaaacatttatgtacttgctgtatacatgaattgtttttcttctttatagggttccctggcttcaaggaagtacgtctggtaccagggaggcatgacattgcttttgttgaatttgaaaatgatgggcaggctggagctgccagggatgctttacagggatttaagatcacaccgtcccatgctatgaagatcacctatgccaagaaataacatttgggatagtcgtctttaaaagacttggtgttatttacagtgtttgttttgataacatttggctgggtcattttaatagttagagatgaggaggagtaaaagtgaaatttttgtgaaggacttaaattatccagtgtttctttagccttggtgaactatgaaatacgaaggccttaattttgtacaataaacttttatttgtattctgtgtatataatgctttcttgattgacccatctccctatcatcaaatgacttctagtctagaacacacttaaggtttataaacttgtgtaataggatgcttttctagtgttactttggaggagctaattatacaacatcattgaaccattcaataaaagttaagtaaaattagatcacagaagctagtagatgactgttgtattaatggtaacaatgattgttctgggtattagaagaaaatgagaccccaggcaggatcctaaatttgatctttgtatccttttaagaaatgaatatattattttgctgctagtagggattccacaagttttcttcattcagtattaaataaaggctgttcttactgtttactgagaaaacagaaagggaatgctatcttcacactttgcatttaatgctgtttccttcatgaggcaggactgttctaaggttaatatgcaatctctttattgaaagacctccagggtaaaaattttttgatctatagtctcttttcccccttaagacaaatagactgattaataaagagttgccagtgctaaaaaaata

SEQ ID NO: 454729 - DNA, 1102 bp, Homo sapiens
ttgaggagcgtggctacgttgcttccggtgcctggctccgtttcctgcttttggttcttacagtagtcggcgtaggccttaggtgggttcgtgcgccttctacctcgctgtttcggttttcctggctcctcggcccttttctcccctgttgcagctgggagcggacgaagcgcgaagctgggattttttactgtctcctgaagaatttaacacaaacatggatatcagaccaaatcatacaatttatatcaacaatatgaatgacaaaattaaaaaggaagaattgaagagatccctatatgccctgttttctcagtttggtcatgtggtggacattgtggctttaaagaccatgaagatgagggggcaggcctttgtcatatttaaggaactgggctcatccacaaatgccttgagacagctacaaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagactgcaacaaccacaaacaaaaagcctggccagggaactccaaattcagctaatacccaaggaaattcaacaccaaatcctcaggtccctgattaccctccaaactatattttattccttaataacttaccagaagagactaatgagatgatgttatccatgctgtttaatcagttccctggcttcaaggaagtacgtctggtaccagggaggcatgacattgcttttgttgaatttgaaaatgatgggcaggctggagctgccagggatgctttacagggatttaagatcacaccgtcccatgctatgaagatcacctatgccaagaaataacatttgggatagtcgtctttaaaagacttggtgttatttacagtgtttgttttgataacatttggctgggtcattttaatagttagagatgaggaggagtaaaagtgaaatttttgtgaaggacttaaattatccagtgtttctttagccttggtgaactatgaaatacgaaggccttaattttgtacaataaacttttatttgtat

SEQ ID NO: 454730 - DNA, 1575 bp, Homo sapiens
ttgaggagcgtggctacgttgcttccggtgcctggctccgtttcctgcttttggttcttacagtagtcggcgtaggccttagattttttactgtctcctgaagaatttaacacaaacatggatatcagaccaaatcatacaatttatatcaacaatatgaatgacaaaattaaaaaggaagaattgaagagatccctatatgccctgttttctcagtttggtcatgtggtggacattgtggctttaaagaccatgaagatgagggggcaggcctttgtcatatttaaggaactgggctcatccacaaatgccttgagacagctacaaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagactgcaacaaccacaaacaaaaagcctggccagggaactccaaattcagctaatacccaaggaaattcaacaccaaatcctcaggtccctgattaccctccaaactatattttattccttaataacttaccagaagagactaatgagatgatgttatccatgctgtttaatcagttccctggcttcaaggaagtacgtctggtaccagggaggcatgacattgcttttgttgaatttgaaaatgatgggcaggctggagctgccagggatgctttacagggatttaagatcacaccgtcccatgctatgaagatcacctatgccaagaaataacatttgggatagtcgtctttaaaagacttggtgttatttacagtgtttgttttgataacatttggctgggtcattttaatagttagagatgaggaggagtaaaagtgaaatttttgtgaaggacttaaattatccagtgtttctttagccttggtgaactatgaaatacgaaggccttaattttgtacaataaacttttatttgtattctgtgtatataatgctttcttgattgacccatctccctatcatcaaatgacttctagtctagaacacacttaaggtttataaacttgtgtaataggatgcttttctagtgttactttggaggagctaattatacaacatcattgaaccattcaataaaagttaagtaaaattagatcacagaagctagtagatgactgttgtattaatggtaacaatgattgttctgggtattagaagaaaatgagaccccaggcaggatcctaaatttgatctttgtatccttttaagaaatgaatatattattttgctgctagtagggattccacaagttttcttcattcagtattaaataaaggctgttcttactgtttactgagaaaacagaaagggaatgctatcttcacactttgcatttaatgctgtttccttcatgaggcaggactgttctaaggttaatatgcaatctctttattgaaagacctccagggtaaaaattttttgatctatagtctcttttcccccttaagacaaatagactgattaataaagagttgccagtgctaaaaaaata

SEQ ID NO: 454731 - DNA, 1417 bp, Homo sapiens
gcggccgcctactactactactgctcgaattcaagcttctaacgatgtacggggacatggaagagacgtgattgcagaaagcagataacaaagcatgaagatgagggggcaggcctttgtcatatttaaggaactgggctcatccacaaatgccttgagacagctacaaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagactgcaacaaccacaaacaaaaagcctggccagggaactccaaattcagctaatacccaaggaaattcaacaccaaatcctcaggtccctgattaccctccaaactatattttattccttaataacttaccagaagagactaatgagatgatgttatccatgctgtttaatcagttccctggcttcaaggaagtacgtctggtaccagggaggcatgacattgcttttgttgaatttgaaaatgatgggcaggctggagctgccagggatgctttacagggatttaagatcacaccgtcccatgctatgaagatcacctatgccaagaaataacatttgggatagtcgtctttaaaagacttggtgttatttacagtgtttgttttgataacatttggctgggtcattttaatagttagagatgaggaggagtaaaagtgaaatttttgtgaaggacttaaattatccagtgtttctttagccttggtgaactatgaaatacgaaggccttaattttgtacaataaacttttatttgtattctgtgtatataatgctttcttgattgacccatctccctatcatcaaatgacttctagtctagaacacacttaaggtttataaacttgtgtaataggatgcttttctagtgttactttggaggagctaattatacaacatcattgaaccattcaataaaagttaagtaaaattagatcacagaagctagtagatgactgttgtattaatggtaacaatgattgttctgggtattagaagaaaatgagaccccaggcaggatcctaaatttgatctttgtatccttttaagaaatgaatatattattttgctgctagtagggattccacaagttttcttcattcagtattaaataaaggctgttcttactgtttactgagaaaacagaaagggaatgctatcttcacactttgcatttaatgctgtttccttcatgaggcaggactgttctaaggttaatatgcaatctctttattgaaagacctccagggtaaaaattttttgatctatagtctcttttcccccttaagacaaatagactgattaataaagagttgccagtgctaaaaaaata

SEQ ID NO: 454732 - DNA, 811 bp, Homo sapiens
ttgaggagcgtggctacgttgcttccggtgcctggctccgtttcctgcttttggttcttacagtagtcggcgtaggccttaggtgggttcgtgcgccttctacctcgctgtttcggttttcctggctcctcggcccttttctcccctgttgcagctgggagcggacgaagcgcgaagctgggattttttactgtctcctgaagaatttaacacaaacatggatatcagaccaaatcatacaatttatatcaacaatatgaatgacaaaattaaaaaggaagaattgaagagatccctatatgccctgttttctcagtttggtcatgtggtggacattgtggctttaaagaccatgaagatgagggggcaggcctttgtcatatttaaggaactgggctcatccacaaatgccttgagacagctacaaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagactgcaacaaccacaaacaaaaagcctggccagggaactccaaattcagctaatacccaaggaaattcaacaccaaatcctcaggtccctgattaccctccaaactatattttattccttaataacttaccagaagagactaatgagatgatgttatccatgctgtttaatcagtaagttttttcataaataagtctgtttctgagagcttcctcacaggacaagtagtacttccgtgggttgaatcca

SEQ ID NO: 454733 - DNA, 885 bp, Homo sapiens
ttgaggagcgtggctacgttgcttccggtgcctggctccgtttcctgcttttggttcttacagtagtcggcgtaggccttaggtgggttcgtgcgccttctacctcgctgtttcggttttcctggctcctcggcccttttctcccctgttgcagctgggagcggacgaagcgcgaagctgggattttttactgtctcctgaagaatttaacacaaacatggatatcagaccaaatcatacaatttatatcaacaatatgaatgacaaaattaaaaaggaagaattgaagagatccctatatgccctgttttctcagtttggtcatgtggtggacattgtggctttaaagaccatgaagatgagggggcaggcctttgtcatatttaaggaactgggctcatccacaaatgccttgagacagctacaaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagactgcaacaaccacaaacaaaaagcctggccagggaactccaaattcagctaatacccaaggaaattcaacaccaaatcctcaggtaattttttttccatgtcgtgcttaccttaaaataagattgtaaaaattacagcagtggtataaaacaatttccatgtctccaaaaacaaaatgatttcatctacaagacacagtgcgttaaattgtctgccactgcaatgtaagaactcaactcctgaagaacattttaattcttttttagagagagaaaacgacacctgactttatttcttgttttccataatgaatcaatgacag

SEQ ID NO: 454734 - DNA, 817 bp, Homo sapiens
ttgaggagcgtggctacgttgcttccggtgcctggctccgtttcctgcttttggttcttacagtagtcggcgtaggccttagattttttactgtctcctgaagaatttaacacaaacatggatatcagaccaaatcatacaatttatatcaacaatatgaatgacaaaattaaaaaggaagaattgaagagatccctatatgccctgttttctcagtttggtcatgtggtggacattgtggctttaaagaccatgaagatgagggggcaggcctttgtcatatttaaggaactgggctcatccacaaatgccttgagacagctacaaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagactgcaacaaccacaaacaaaaagcctggccaggttccctggcttcaaggaagtacgtctggtaccagggaggcatgacattgcttttgttgaatttgaaaatgatgggcaggctggagctgccagggatgctttacagggatttaagatcacaccgtcccatgctatgaagatcacctatgccaagaaataacatttgggatagtcgtctttaaaagacttggtgttatttacagtgtttgtttgtacatgggtggtcattatagtagcgatgggagggtaagtgaaatttggacgataatatcaggtcttgcctgggacttgaaaagaggctatttggcaaacttttctaaac

SEQ ID NO: 454735 - DNA, 2254 bp, Homo sapiens
aaatcggtacaagatggcggagggggacgaggcagcgcgagggcagcaaccgcaccaggggctgtggcgccggcgacggaccagcgacccaagcgccgcggttaaccacgtctcgtccacgacctccctaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggtgttttccaaactgtttgaagttactagacgtcgaatggttcaccgtgctctttcatcagcacagcgacagagactgtcatccaacaataacaagaagaaaaattagacagtatttttaacctttttctctatctgaagtgttcacacttacacatgtaggacaataagcaggaccgtctgggccggtctgcataaatgctgtatacataccagatttgatgctgcatatagggtatggaattgcacatccatctcataggaattgtaaatggtttgaataagaggaaagtaatttttgttgcattataaaatgtctagtagcatcataagtttttttgagagaagcatctttttatttcccatattcctggttattttcatcattgctttgaattgaatttttatatctatttttatatgtaactctttttttacctcatgtttttgtttgttttgcacatttctcataccacaggtattgaagcccctgggtgataatttgatggaggaaaacataaggcagtctgtaacaaactctatcaaagcaggcctgactgaccaggtgtctcatcatgccagattaaagacagactgacagttcatctcc

SEQ ID NO: 454736 - DNA, 3678 bp, Homo sapiens
aaatcggtacaagatggcggagggggacgaggcagcgcgagggcagcaaccgcaccaggggctgtggcgccggcgacggaccagcgacccaagcgccgcggttaaccacgtctcgtccacgacctccctagagtcttgctctgtcgccaggttggagtgcagtggcacgatcttcgcttactgcaacctcccgggttcaagtgattcctctgcctcagcctcccaagtagctgggattacaggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaactgtagaagtagtttagtgtaactggcttcacagatggctgccacagagtgtgaagattgtttgttagttttaagcattcttttaatggctcctaagacatgcagatggactgaggagcattggttaatcatgcacctttgtgccatgtttaactcttttatttctttttacttaatctaatgttagtgaatttgtcttatgtaaaaggatatttcagggaaatattttcagaaatctatttagagtctctttaacacagtgtcccattgaaattttaatttttagagaatttatgaatcactgtttcaagaaccagattggaaagacaatgaagcctttattgagccactacattaaaagtatatattgctttactgccttcaataccagtattacatcaatgcatgtatcagaaacttcacagaaattacatggcaactcttgtagctaagaaagtaattctgaggtgtacatttgtcttgcctttttaaatttataaacttgccctaaaaggagatgcatatctgggaaactgaactgtctttttgcagtttagccttcatgtatataaaatatgccattaattttattggggaagaaattccatccaaaaatgttgcctacagctatgagttaagagtgtctgtacagtgtgtagcttttattttctaaaatcacagatagggcatgtatatgacttataaatatataaatacgattttgtattaaaagttttgtagtttatggcaaaatctggtcctgtggtaggctaaataagtactgtccctgtgaaaggaatgtttgtggctcatgtcagtgtgtgaatgcatagacaatttgaagtttttgatatatttgtgatatttatcttgagcactgcaatctcaccccccccccgcccaccaagggaattcaatgggaatgtttattgtgactttgtcctctgttgcattttaaagttatttcctgtaatttattttcagtacataattaaaaatttgttgtatatataaaatgaaacttgtgattcttttttaaggaatttttcaagtatgtattccacttcataaaccacatttgtttatagtgaaaagagcatgagcaggaaacaccccagttgagagctctaaggcattgtacctcaaaactaagcttgtaaaaagttacttttctgtgtctgtctctataagggaaaacctatgattagcctagttgtagatggggattgttaatttctttctctctctttttttttttggggggtatatgtaaggctagcattttttcagtactttggtggtcttctttgtgaacaccgattaaagtacctagtttggttggttcctttttggagacggagtctctctctgtcacccaggctggagtgcagtggtgcgatctgggctcactgcaacctccacctcctgggttcaagtgattctcccgcctcagcctcctgagtagctgggactacaggtgcgtgccaccattcccggctaatgtttcctattttaagtagagatggggtttcaccgttttagccaggatggtctcaatcgcctgaccttgtgatccgcctgccttggcctcccaaagtgttgggattacaggcgtgagccaccgcgcccggcccttagtttgctttttaagcgaagagaatgcaggtgttgagttgcatgtgtgaaaactctgaatttactttggttgatacatcttcgctcccactcccattcagattctgtttttatatggattgtatttgttttcatctgtattaaattgctaacttatctgttcttaaagaatccacctgaaaagtgtctttttatttcttctgccaccctgttttatgaatgctgtggactgttttttatgaatgaaaaaataatttgttgtataatagcagattttctgaaattaaagacagcttacttttaaaaagttataaaatct

SEQ ID NO: 454737 - DNA, 3572 bp, Homo sapiens
aaatcggtacaagatggcggagggggacgaggcagcgcgagggcagcaaccgcaccaggggctgtggcgccggcgacggaccagcgacccaagcgccgcggttaaccacgtctcgtccacgacctccctaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaactgtagaagtagtttagtgtaactggcttcacagatggctgccacagagtgtgaagattgtttgttagttttaagcattcttttaatggctcctaagacatgcagatggactgaggagcattggttaatcatgcacctttgtgccatgtttaactcttttatttctttttacttaatctaatgttagtgaatttgtcttatgtaaaaggatatttcagggaaatattttcagaaatctatttagagtctctttaacacagtgtcccattgaaattttaatttttagagaatttatgaatcactgtttcaagaaccagattggaaagacaatgaagcctttattgagccactacattaaaagtatatattgctttactgccttcaataccagtattacatcaatgcatgtatcagaaacttcacagaaattacatggcaactcttgtagctaagaaagtaattctgaggtgtacatttgtcttgcctttttaaatttataaacttgccctaaaaggagatgcatatctgggaaactgaactgtctttttgcagtttagccttcatgtatataaaatatgccattaattttattggggaagaaattccatccaaaaatgttgcctacagctatgagttaagagtgtctgtacagtgtgtagcttttattttctaaaatcacagatagggcatgtatatgacttataaatatataaatacgattttgtattaaaagttttgtagtttatggcaaaatctggtcctgtggtaggctaaataagtactgtccctgtgaaaggaatgtttgtggctcatgtcagtgtgtgaatgcatagacaatttgaagtttttgatatatttgtgatatttatcttgagcactgcaatctcaccccccccccgcccaccaagggaattcaatgggaatgtttattgtgactttgtcctctgttgcattttaaagttatttcctgtaatttattttcagtacataattaaaaatttgttgtatatataaaatgaaacttgtgattcttttttaaggaatttttcaagtatgtattccacttcataaaccacatttgtttatagtgaaaagagcatgagcaggaaacaccccagttgagagctctaaggcattgtacctcaaaactaagcttgtaaaaagttacttttctgtgtctgtctctataagggaaaacctatgattagcctagttgtagatggggattgttaatttctttctctctctttttttttttggggggtatatgtaaggctagcattttttcagtactttggtggtcttctttgtgaacaccgattaaagtacctagtttggttggttcctttttggagacggagtctctctctgtcacccaggctggagtgcagtggtgcgatctgggctcactgcaacctccacctcctgggttcaagtgattctcccgcctcagcctcctgagtagctgggactacaggtgcgtgccaccattcccggctaatgtttcctattttaagtagagatggggtttcaccgttttagccaggatggtctcaatcgcctgaccttgtgatccgcctgccttggcctcccaaagtgttgggattacaggcgtgagccaccgcgcccggcccttagtttgctttttaagcgaagagaatgcaggtgttgagttgcatgtgtgaaaactctgaatttactttggttgatacatcttcgctcccactcccattcagattctgtttttatatggattgtatttgttttcatctgtattaaattgctaacttatctgttcttaaagaatccacctgaaaagtgtctttttatttcttctgccaccctgttttatgaatgctgtggactgttttttatgaatgaaaaaataatttgttgtataatagcagattttctgaaattaaagacagcttacttttaaaaagttataaaatct

SEQ ID NO: 454738 - DNA, 2967 bp, Homo sapiens
acaatcagcaggtggcaaatctagcaagttccctctggccttgggtgggtccagagatgctctctggtgatccgcctgccttggcctcccaaattgctgggattacaggtgtgagccatcacacctggcctttgtctcctttactcaagcaggagactctcctcatagccacaacatctgggaatgtgctgggtcacacctgaagccagcacatttctgaatctcacccaaggcccatagcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaactgtagaagtagtttagtgtaactggcttcacagatggctgccacagagtgtgaagattgtttgttagttttaagcattcttttaatggctcctaagacatgcagatggactgaggagcattggttaatcatgcacctttgtgccatgtttaactcttttatttctttttacttaatctaatgttagtgaatttgtcttatgtaaaaggatatttcagggaaatattttcagaaatctatttagagtctctttaacacagtgtcccattgaaattttaatttttagagaatttatgaatcactgtttcaagaaccagattggaaagacaatgaagcctttattgagccactacattaaaagtatatattgctttactgccttcaataccagtattacatcaatgcatgtatcagaaacttcacagaaattacatggcaactcttgtagctaagaaagtaattctgaggtgtacatttgtcttgcctttttaaatttataaacttgccctaaaaggagatgcatatctgggaaactgaactgtctttttgcagtttagccttcatgtatataaaatatgccattaattttattggggaagaaattccatccaaaaatgttgcctacagctatgagttaagagtgtctgtacagtgtgtagcttttattttctaaaatcacagatagggcatgtatatgacttataaatatataaatacgattttgtattaaaagttttgtagtttatggcaaaatctggtcctgtggtaggctaaataagtactgtccctgtgaaaggaatgtttgtggctcatgtcagtgtgtgaatgcatagacaatttgaagtttttgatatatttgtgatatttatcttgagcactgcaatctcaccccccccccgcccaccaagggaattcaatgggaatgtttattgtgactttgtcctctgttgcattttaaagttatttcctgtaatttattttcagtacataattaaaaatttgttgtatatataaaatgaaacttgtgattcttttttaaggaatttttcaagtatgtattccacttcataaaccacatttgtttatagtgaaaagagcatgagcaggaaacaccccagttgagagctctaaggcattgtacctcaaaactaagcttgtaaaaagttacttttctgtgtctgtctctataagggaaaacctatgattagcctagttgtagatggggattgttaatttctttctctctctttttttttttggggggtatatgtaaggctagcattttttcagtactttggtggtcttctttgtgaacaccgattaaagtacctagtttggttggttcctttttggagacggagtctctctctgtcacccaggctggagtgcagtggtgcgatctgggctcactgcaacctccacctcctgggttcaagtgattctcccgcctcagcctcctgagtagctgggactacaggtgcgtgccaccattcccggctaatgtttcctattttaagtagagatggggtttcaccgttttagccaggatggtctcaatcgcctgaccttgtgatccgcctgccttggcctcccaaagtgttgggattacaggcgtgagccaccgcgcccggcccttagtttgctttttaagcgaagagaatgcaggtgttgagttgcatgtgtgaaaactctgaatttactttggttgatacatcttcgctcccactcccattcagattctgtttttatatggattgtatttgttttcatctgtattaaattgctaacttatctgttcttaaagaatccacctgaaaagtgtctttttatttcttctgccaccctgttttatgaatgctgtggactgttttttatgaatgaaaaaataatttgttgtataatagcagattttctgaaattaaagacagcttacttttaaaaagttataaaatct

SEQ ID NO: 454739 - DNA, 234 bp, Homo sapiens
ttttcagacttgtttattgtacataacttattgtgttaatcagaatttttagagtcatagagtattttttgcataataatggcatattttattttttaggcaacagctgaagctaataatcttgctgcagtagcaggagcaagagatacctattgtaaaagtatggaacaggtttgtacctaaaatttaaatttgatgctggagtgagaagatttttaaattaaaaaaaaaaaa

SEQ ID NO: 454740 - DNA, 3812 bp, Homo sapiens
aaatcggtacaagatggcggagggggacgaggcagcgcgagggcagcaaccgcaccaggggctgtggcgccggcgacggaccagcgacccaagcgccgcggttaaccacgtctcgtccacgacctccctaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaactgtagaagtagtttagtgtaactggcttcacagatggctgccacagagtgtgaagattgtttgttagttttaagcattcttttaatggctcctaagacatgcagatggactgaggagcattggttaatcatgcacctttgtgccatgtttaactcttttatttctttttacttaatctaatgttagtgaatttgtcttatgtaaaaggatatttcagggaaatattttcagaaatctatttagagtctctttaacacagtgtcccattgaaattttaatttttagagaatttatgaatcactgtttcaagaaccagattggaaagacaatgaagcctttattgagccactacattaaaagtatatattgctttactgccttcaataccagtattacatcaatgcatgtatcagaaacttcacagaaattacatggcaactcttgtagctaagaaagtaattctgaggtgtacatttgtcttgcctttttaaatttataaacttgccctaaaaggagatgcatatctgggaaactgaactgtctttttgcagtttagccttcatgtatataaaatatgccattaattttattggggaagaaattccatccaaaaatgttgcctacagctatgagttaagagtgtctgtacagtgtgtagcttttattttctaaaatcacagatagggcatgtatatgacttataaatatataaatacgattttgtattaaaagttttgtagtttatggcaaaatctggtcctgtggtaggctaaataagtactgtccctgtgaaaggaatgtttgtggctcatgtcagtgtgtgaatgcatagacaatttgaagtttttgatatatttgtgatatttatcttgagcactgcaatctcaccccccccccgcccaccaagggaattcaatgggaatgtttattgtgactttgtcctctgttgcattttaaagttatttcctgtaatttattttcagtacataattaaaaatttgttgtatatataaaatgaaacttgtgattcttttttaaggaatttttcaagtatgtattccacttcataaaccacatttgtttatagtgaaaagagcatgagcaggaaacaccccagttgagagctctaaggcattgtacctcaaaactaagcttgtaaaaagttacttttctgtgtctgtctctataagggaaaacctatgattagcctagttgtagatggggattgttaatttctttctctctctttttttttttggggggtatatgtaaggctagcattttttcagtactttggtggtcttctttgtgaacaccgattaaagtacctagtttggttggttcctttttggagacggagtctctctctgtcacccaggctggagtgcagtggtgcgatctgggctcactgcaacctccacctcctgggttcaagtgattctcccgcctcagcctcctgagtagctgggactacaggtgcgtgccaccattcccggctaatgtttcctattttaagtagagatggggtttcaccgttttagccaggatggtctcaatcgcctgaccttgtgatccgcctgccttggcctcccaaagtgttgggattacaggcgtgagccaccgcgcccggcccttagtttgctttttaagcgaagagaatgcaggtgttgagttgcatgtgtgaaaactctgaatttactttggttgatacatcttcgctcccactcccattcagattctgtttttatatggattgtatttgttttcatctgtattaaattgctaacttatctgttcttaaagaatccacctgaaaagtgtctttttatttcttctgccaccctgttttatgaatgctgtggactgttttttatgaatgaaaaaataatttgttgtataatagcagattttctgaaattaaagacagcttacttttaaaaagttataaaatct

SEQ ID NO: 454741 - DNA, 4289 bp, Homo sapiens
aaatcggtacaagatggcggagggggacgaggcagcgcgagggcagcaaccgcaccaggggctgtggcgccggcgacggaccagcgacccaagcgccgcggttaaccacgtctcgtccacgacctccctaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggtgttttccaaactgtttgaagttactagacgtcgaatggttcaccgtgctctttcatcagcacagcgacagagactgtcatccaacaataacaagaagaaaaattagacagtatttttaacctttttctctatctgaagtgttcacacttacacatgtaggacaataagcaggaccgtctgggccggtctgcataaatgctgtatacataccagatttgatgctgcatatagggtatggaattgcacatccatctcataggaattgtaaatggtttgaataagaggaaagtaatttttgttgcattataaaatgtctagtagcatcataagtttttttgagagaagcatctttttatttcccatattcctggttattttcatcattgctttgaattgaatttttatatctatttttatatgtaactctttttttacctcatgtttttgtttgttttgcacatttctcataccacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaactgtagaagtagtttagtgtaactggcttcacagatggctgccacagagtgtgaagattgtttgttagttttaagcattcttttaatggctcctaagacatgcagatggactgaggagcattggttaatcatgcacctttgtgccatgtttaactcttttatttctttttacttaatctaatgttagtgaatttgtcttatgtaaaaggatatttcagggaaatattttcagaaatctatttagagtctctttaacacagtgtcccattgaaattttaatttttagagaatttatgaatcactgtttcaagaaccagattggaaagacaatgaagcctttattgagccactacattaaaagtatatattgctttactgccttcaataccagtattacatcaatgcatgtatcagaaacttcacagaaattacatggcaactcttgtagctaagaaagtaattctgaggtgtacatttgtcttgcctttttaaatttataaacttgccctaaaaggagatgcatatctgggaaactgaactgtctttttgcagtttagccttcatgtatataaaatatgccattaattttattggggaagaaattccatccaaaaatgttgcctacagctatgagttaagagtgtctgtacagtgtgtagcttttattttctaaaatcacagatagggcatgtatatgacttataaatatataaatacgattttgtattaaaagttttgtagtttatggcaaaatctggtcctgtggtaggctaaataagtactgtccctgtgaaaggaatgtttgtggctcatgtcagtgtgtgaatgcatagacaatttgaagtttttgatatatttgtgatatttatcttgagcactgcaatctcaccccccccccgcccaccaagggaattcaatgggaatgtttattgtgactttgtcctctgttgcattttaaagttatttcctgtaatttattttcagtacataattaaaaatttgttgtatatataaaatgaaacttgtgattcttttttaaggaatttttcaagtatgtattccacttcataaaccacatttgtttatagtgaaaagagcatgagcaggaaacaccccagttgagagctctaaggcattgtacctcaaaactaagcttgtaaaaagttacttttctgtgtctgtctctataagggaaaacctatgattagcctagttgtagatggggattgttaatttctttctctctctttttttttttggggggtatatgtaaggctagcattttttcagtactttggtggtcttctttgtgaacaccgattaaagtacctagtttggttggttcctttttggagacggagtctctctctgtcacccaggctggagtgcagtggtgcgatctgggctcactgcaacctccacctcctgggttcaagtgattctcccgcctcagcctcctgagtagctgggactacaggtgcgtgccaccattcccggctaatgtttcctattttaagtagagatggggtttcaccgttttagccaggatggtctcaatcgcctgaccttgtgatccgcctgccttggcctcccaaagtgttgggattacaggcgtgagccaccgcgcccggcccttagtttgctttttaagcgaagagaatgcaggtgttgagttgcatgtgtgaaaactctgaatttactttggttgatacatcttcgctcccactcccattcagattctgtttttatatggattgtatttgttttcatctgtattaaattgctaacttatctgttcttaaagaatccacctgaaaagtgtctttttatttcttctgccaccctgttttatgaatgctgtggactgttttttatgaatgaaaaaataatttgttgtataatagcagattttctgaaattaaagacagcttacttttaaaaagttataaaatct

SEQ ID NO: 454742 - DNA, 2853 bp, Homo sapiens
cagatacagagcacagtgtaaaatttttttgtcttcagtttccgttagtcatatttggaaaatgattttgcttgagtaggttcaacatataaacaataactagattatgataacctgtgaggtattgtaagtgagtttaaaactgactcaatcatgtaagtggtttgactttctgagactaaaaactatgaacaggaacttctttcaagtgttaattatttctagcatgtaatactgtaattctgtctgtccaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaactgtagaagtagtttagtgtaactggcttcacagatggctgccacagagtgtgaagattgtttgttagttttaagcattcttttaatggctcctaagacatgcagatggactgaggagcattggttaatcatgcacctttgtgccatgtttaactcttttatttctttttacttaatctaatgttagtgaatttgtcttatgtaaaaggatatttcagggaaatattttcagaaatctatttagagtctctttaacacagtgtcccattgaaattttaatttttagagaatttatgaatcactgtttcaagaaccagattggaaagacaatgaagcctttattgagccactacattaaaagtatatattgctttactgccttcaataccagtattacatcaatgcatgtatcagaaacttcacagaaattacatggcaactcttgtagctaagaaagtaattctgaggtgtacatttgtcttgcctttttaaatttataaacttgccctaaaaggagatgcatatctgggaaactgaactgtctttttgcagtttagccttcatgtatataaaatatgccattaattttattggggaagaaattccatccaaaaatgttgcctacagctatgagttaagagtgtctgtacagtgtgtagcttttattttctaaaatcacagatagggcatgtatatgacttataaatatataaatacgattttgtattaaaagttttgtagtttatggcaaaatctggtcctgtggtaggctaaataagtactgtccctgtgaaaggaatgtttgtggctcatgtcagtgtgtgaatgcatagacaatttgaagtttttgatatatttgtgatatttatcttgagcactgcaatctcaccccccccccgcccaccaagggaattcaatgggaatgtttattgtgactttgtcctctgttgcattttaaagttatttcctgtaatttattttcagtacataattaaaaatttgttgtatatataaaatgaaacttgtgattcttttttaaggaatttttcaagtatgtattccacttcataaaccacatttgtttatagtgaaaagagcatgagcaggaaacaccccagttgagagctctaaggcattgtacctcaaaactaagcttgtaaaaagttacttttctgtgtctgtctctataagggaaaacctatgattagcctagttgtagatggggattgttaatttctttctctctctttttttttttggggggtatatgtaaggctagcattttttcagtactttggtggtcttctttgtgaacaccgattaaagtacctagtttggttggttcctttttggagacggagtctctctctgtcacccaggctggagtgcagtggtgcgatctgggctcactgcaacctccacctcctgggttcaagtgattctcccgcctcagcctcctgagtagctgggactacaggtgcgtgccaccattcccggctaatgtttcctattttaagtagagatggggtttcaccgttttagccaggatggtctcaatcgcctgaccttgtgatccgcctgccttggcctcccaaagtgttgggattacaggcgtgagccaccgcgcccggcccttagtttgctttttaagcgaagagaatgcaggtgttgagttgcatgtgtgaaaactctgaatttactttggttgatacatcttcgctcccactcccattcagattctgtttttatatggattgtatttgttttcatctgtattaaattgctaacttatctgttcttaaagaatccacctgaaaagtgtctttttatttcttctgccaccctgttttatgaatgctgtggactgttttttatgaatgaaaaaataatttgttgtataatagcagattttctgaaattaaagacagcttacttttaaaaagttataaaatct

SEQ ID NO: 454743 - DNA, 664 bp, Homo sapiens
cattgggatttcggtcctggtggtccctaatttgaagttttttttccatggcttagaggtatttccaatgagaaatgaaaactggccctggggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaattaa

SEQ ID NO: 454744 - DNA, 625 bp, Homo sapiens
taggagatagatgtgtcacgtgaatctagtcaccccaaccaaacaattttagggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaattaa

SEQ ID NO: 454745 - DNA, 1319 bp, Homo sapiens
acttgttagggagggcgggcctgtttccgggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaattaaaaaaaaaaaaaaaaaaaaaaaaaaaaaaaaaaaaaaaaaaaaaaaaaaaaaaaaaaaaagggaaaaaaaaaaaaaaaaaaaaaaaaaaaaccttgtgggccgcttgggccaagtcgattttagactggacaaggtttatccttgcgcccaaatttggggctaattggcccatttggccttatggggggcggtataacaattaatggcccgcggtttaacaaggtgggcatgggagtg

SEQ ID NO: 454746 - DNA, 1029 bp, Homo sapiens
  misc_feature (1015)..(1015): n is a, c, g, or t
acttgttagggagggcgggcctgtttccgggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagatatagaagaggcacntttgggaccgagcc

SEQ ID NO: 454747 - DNA, 903 bp, Homo sapiens
acttgttagggagggcgggcctgtttccgggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccacctactcactatcaatacattcatgtattgatatgacgttggaggatgaaccagatagtgaggaaagttgagccaatatattacttgaagtccg

SEQ ID NO: 454748 - DNA, 1080 bp, Homo sapiens
tgcgtggggctgagggcgagaacggtccttgatgctgccaatatggggactctgtaccgtgtcgcgcactaaggctggcgagtgtcctaacctggaagcatagaaagaagcggggcctggtggagacgatgtcggatcggactatgaacatgtgtattgttcatgtctggtgagtgttcttacattccctcgatcaatcggaggaaatcatctggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaattaa

SEQ ID NO: 454749 - DNA, 999 bp, Homo sapiens
caacctgggcgacagagtgagactctgtctcaaaaaaaaaaaagtaaatgaaccttaagagacaatgaaaactataatcctgttttcaaaaattagtaatacaatctaatctgttctgttgtctttcttataggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaattaa

SEQ ID NO: 454750 - DNA, 1028 bp, Homo sapiens
acttgttagggagggcgggcctgtttccgggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccttttttcatggctagagtattcatgagaatgaaactgccgggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaattaa

SEQ ID NO: 454751 - DNA, 1013 bp, Homo sapiens
acttgttagggagggcgggcctgtttccgggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaattaa

SEQ ID NO: 454752 - DNA, 811 bp, Homo sapiens
acttgttagggagggcgggcctgtttccgggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaacaggaggtatgagtggacaaaattctctggctaagagcagtttccagaatttttctggggatgggtaccaggtgtgggggtctcttggtttaaaatttcattccttttacaagggttttaccttcattttgggggcttttgaaacaaaacagc

SEQ ID NO: 454753 - DNA, 1055 bp, Homo sapiens
agctgatatccgaggttcatttttagcaaataagggacgtaattcattctaaagaaacaaaacatttgtacagctgctgaggacaatgtgtagtagagagggtgaggaatttggagtccagttttggcctgccacttaatagctctgagactttggattagttctgtgaactctcttggcctcaggttccaaacctgttaaatgaagtattaatgtaccttggggagttacagttgtcaacattaaatgagaaggtgtgctctcaatcataatgtaagtgttaatcaatgtcagtgttttcattctaaagatagagtcctaaaagttctgtttcaagttagattatggccacagtttcaaaaataaatgaataaaccattactgtttttgttttgtttcgtattgagacggagtctcgctctgttgcccaggctggagtgcagtggcgtgatctcggctcactacaaactctgcctcccaggggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaattaa

SEQ ID NO: 454754 - DNA, 763 bp, Homo sapiens
cactatgtagatggggtgaggggggcaaaatatgaaataaggaccataataaagaatcacgcaattatatttttggattgttatttgatatatcataaaatttgttttggcattttgaaatactatgataataagagaatataaaaacaattcttttcactttttgtgcttataattatatttctgcaggggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaattaa

SEQ ID NO: 454755 - DNA, 424 bp, Homo sapiens
  misc_feature (391)..(391): n is a, c, g, or t
  misc_feature (410)..(410): n is a, c, g, or t
acttgttagggagggcgggcctgtttccgggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttttaagggcttttcatttnccctgggaccccggatccngttggcctaccccc

SEQ ID NO: 454756 - DNA, 1082 bp, Homo sapiens
acttgttagggagggcgggcctgtttccgggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaattaa

SEQ ID NO: 454757 - DNA, 1193 bp, Homo sapiens
cgaaaacttgtaatcagcactcacctaattaggggtcatcgccggaccgaagacgagcgcaggatcagtgacgagaagggcgatactcgtatacaactatcgaagtatagcgaggacggaattgccggattcggcatacgcggagcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaattaa

SEQ ID NO: 454758 - DNA, 1152 bp, Homo sapiens
cgaaaacttgtaatcagcactcacctaattaggggtcatcgccggaccgaagacgagcgcaggatcagtgacgagaagggcgatactcgtatacaactatcgaagtatagcgaggacggaattgccggattcggcatacgcggagcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaattaa

SEQ ID NO: 454759 - DNA, 1101 bp, Homo sapiens
ggctgtatccggcgaggcgggtggcggcttgaggtcgaataacggaccttggtgactacctgtatgctaagttagttcaccggtgttccagtactgcattgctctgtatctgtccacatacactgaaagcctggagaggagagccgcgcatggttgcgcaatgccgttcggactgaggacttgtgtatgctggtgtgtgggtgtctctacttgcctctatcaaccggaggtcataaattctatgtatgttcatcgtcggagcctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaattaa

SEQ ID NO: 454760 - DNA, 884 bp, Homo sapiens
acttgttagggagggcgggcctgtttccgggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacaggggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaattaa

SEQ ID NO: 454761 - DNA, 1121 bp, Homo sapiens
acttgttagggagggcgggcctgtttccgggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacaggggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaattaaaaaaaaaaaaaaaaaaaaaaaaaaaaaaaaaaaaaaaaaaaaaaaaaaaaaaaaaaaaagggaaaaaaaaaaaaaaaaaaaaaaaaaaaaccttgtgggccgcttgggccaagtcgattttagactggacaaggtttatccttgcgcccaaatttggggctaattggcccatttggccttatggggggcggtataacaattaatggcccgcggtttaacaaggtgggcatgggagtg

SEQ ID NO: 454762 - DNA, 2694 bp, Homo sapiens
agcctcgcggtgccgcgccctggggcgggcctgcccatggcctgccgggaaatgtagtttctgatgccctgcccgcgccgcctcgccgctcgccggccgggcgccccaagcaactacaacttccatcacgctctgcgaggccttgatctgcaggcttttgcaggggaaggagtggggcgaacatggctgaaggaagccgaggtggccctacgtgtagcggggtgggtggcaggcaggacccagtctccggcagtggcggctgcaactttccagagtatgagcttcccgagctaaatacgcgcgctttccatgtgggcgcctttggggagctgtggcggggccgtctgcgcggggccggggacttgtcgctgagggagccgccggcatccgctctgcctgggagccaggcagctgactccgaccgggaggatgccgcggtggccagggatctggactgcagcctggaggcggcggctgagctgagggcggtgtgcggccttgataaactgaaatgccttgaggacggtgaggatccagaagtcattccggagaatactgacctggtgactttgggggttagaaaaaggttcttggaacatcgggaagaaaccattacaatagatcgagcctgcagacaagaaacattcgtttatgagatggagtcacatgccataggaaaaaagcctgaaaattcagcagacatgattgaagaaggggagcttatcctatctgtgaatatcttgtaccctgttatatttcataagcacaaagaacacaaaccataccaaacaatgctggtgttgggcagtcaaaaactcacacaactgagggattcaattcgatgtgtcagtgacctccagattggtggtgaattcagcaacactcctgaccaagcccctgagcacatcagcaaagacctatacaaatcagccttcttttattttgaaggaacattttataatgataaaagatacccagaatgcagagatttgagcagaactatcattgagtggtcagagtcccatgatagaggctatggaaagtttcagactgctagaatggaagatttcaccttcaatgacttgtgtattaaactgggttttccttacttatactgtcatcagggagactgtgaacatgtcattgtcattactgacataaggcttgtgcatcatgatgactgcttggataggacattgtatcccctccttatcaagaagcattggctatggaccagaaaatgttttgtttgtaaaatgtatacagccagatgggtgacgaacaatgacagttttgcaccagaggacccatgcttcttttgtgatgtttgcttccgaatgctgcactatgattcagaaggcaacaaactgggggaattccttgcttatccttatgttgatcctggaacctttaattaagaatagctacactcacaaaaataccccctcatgaaataactgttctcttggatggttaccttatttctaagaaacgccactgaggaacaggatccactttgaacagtccgctaaagctatcaaaaaaaagtccaaatcacagattttcttataatgatagtatttaaatgtttataacatagtttaattttatatttattccagatagtatttaatttagtgctttttacccattttgagttgagttgtagtactttatatattctgactttaaatcctttgtcagacacacatattctttctcccaatccatgccttccctattcattctctgtccagagttttttgctaaagatagaattattaatgatacatcaagtagtggaagtgttttgaaaattctttgaagaatgtgagagctacaccttctaccatgaggcttccaaggttgtatttaaatttgactgaatatctggatggctaagaacagacatttatcttacacatggaaaactgacgaaacctataagcctatgtgtttgacagtgaagtatgttttatggacttaaatgccacaaacagttaagtccattggcttggagatgacaagcacgagtttctggtatgtctagtgttctcattcactgattcagtcagtacacagataatcactatagagaacttaagaggctggcttatgttatacctaaatttttactttcttgtatacaacaatgctaaaattgagcagattgataactgccagcaaaccatagatttaagataaatgaatgatttacccaaccctaaaattccatgggtaaattttgattcctttattttcaatactgcgttccttataggtcttacatcgcatatcgcaaggatattttatcttattcattcatttcatactctcaaaacaccaaacttcaaaaagttaattattgtcataatgcattattccatgtgtggtgtcaatacattttagcggacaaagaagaaacatgccagttaaaacatttctgctactggattctttattaattatttgagaacgttattttgctagttcttaaggttaagtttttcatcaaagactcaggtacctattattgttccctggtgaaactgaggagaaaagttaatcaaccaggttactcccacagtttgcccgtgtgttatgtatcagttatacaggtatcccaccaagttcaagtcaaaagaaattcctaactttgtatatttctggagctatataaacccctgatttaag

SEQ ID NO: 454763 - DNA, 1052 bp, Homo sapiens
agcctcgcggtgccgcgccctggggcgggcctgcccatggcctgccgggaaatgtagtttctgatgccctgcccgcgccgcctcgccgctcgccggccgggcgccccaagcaactacaacttccatcacgctctgcgaggccttgatctgcaggcttttgcaggggaaggagtggggcgaacatggctgaaggaagccgaggtggccctacgtgtagcggggtgggtggcaggcaggacccagtctccggcagtggcggctgcaactttccagagtatgagcttcccgagctaaatacgcgcgctttccatgtgggcgcctttggggagctgtggcggggccgtctgcgcggggccggggacttgtcgctgagggagccgccggcatccgctctgcctgggagccaggcagctgactccgaccgggaggatgccgcggtggccagggatctggactgcagcctggaggcggcggctgagctgagggcggtgtgcggccttgataaactgaaatgccttgaggacggtgaggatccagaagtcattccggagaatactgacctggtgactttgggggttagaaaaaggttcttggaacatcgggaagaaaccattacaatagatcgagcctgcagacaagaaacattcgtttatgagatggagtcacatgccataggaaaaaagcctgaaaattcagcagacatgattgaagaaggggagcttatcctatctgtgaatatcttgtaccctgttatatttcataagcacaaagaacacaaaccataccaaacaatgctggtgttgggcagtcaaaaactcacacaactgagggattcaattcgatgtgtcagtgacctccagattggtggtgaattcagcaacactcctgaccaagcccctgagcacatcagcaaagacctatacaaatcagccttcttttattttgaaggaacattttataatgataaaagatacccagaatgcagagatttgagcagaactatcattgacgtggtcacgagtcccatggataagaggcaatgggaaagttcc

SEQ ID NO: 454764 - DNA, 248 bp, Homo sapiens
tgcttctatctaactccttcagatacacagtggaacaaagcaagacttcaactatggctccatagcctattttagggtgggtattaaaaaatagcctgtgatggccgggcatgttggctcacagctgtaatcccaacactgggaagccaaggtgggtggatcacctgaggtcaggagttcgaggccgggctggccaacatggtgaaacctcatctctactaaaaatacaaaaaattagatgggcgtgg

SEQ ID NO: 454765 - DNA, 4012 bp, Homo sapiens
agcctcgcggtgccgcgccctggggcgggcctgcccatggcctgccgggaaatgtagtttctgatgccctgcccgcgccgcctcgccgctcgccggccgggcgccccaagcaactacaacttccatcacgctctgcgaggccttgatctgcaggcttttgcaggggaaggagtggggcgaacatggctgaaggaagccgaggtggccctacgtgtagcggggtgggtggcaggcaggacccagtctccggcagtggcggctgcaactttccagagtatgagcttcccgagctaaatacgcgcgctttccatgtgggcgcctttggggagctgtggcggggccgtctgcgcggggccggggacttgtcgctgagggagccgccggcatccgctctgcctgggagccaggcagctgactccgaccgggaggatgccgcggtggccagggatctggactgcagcctggaggcggcggctgagctgagggcggtgtgcggccttgataaactgaaatgccttgaggacggtgaggatccagaagtcattccggagaatactgacctggtgactttgggggttagaaaaaggttcttggaacatcgggaagaaaccattacaatagatcgagcctgcagacaagaaacattcgtttatgagatggagtcacatgccataggaaaaaagcctgaaaattcagcagacatgattgaagaaggggagcttatcctatctgtgaatatcttgtaccctgttatatttcataagcacaaagaacacaaaccataccaaacaatgctggtgttgggcagtcaaaaactcacacaactgagggattcaattcgatgtgtcagtgacctccagattggtggtgaattcagcaacactcctgaccaagcccctgagcacatcagcaaagacctatacaaatcagccttcttttattttgaaggaacattttataatgataaaagatacccagaatgcagagatttgagcagaactatcattgagtggtcagagtcccatgatagaggctatggaaagtttcagactgctagaatggaagatttcaccttcaatgacttgtgtattaaactgggttttccttacttatactgtcatcagggagactgtgaacatgtcattgtcattactgacataaggcttgtgcatcatgatgactgcttggataggacattgtatcccctccttatcaagaagcattggctatggaccagaaaatgttttgtttgtaaaatgtatacagccagatgggtgacgaacaatgacagttttgcaccagaggacccatgcttcttttgtgatgtttgcttccgaatgctgcactatgattcagaaggcaacaaactgggggaattccttgcttatccttatgttgatcctggaacctttaattaagaatagctacactcacaaaaataccccctcatgaaataactgttctcttggatggttaccttatttctaagaaacgccactgaggaacaggatccactttgaacagtccgctaaagctatcaaaaaaaagtccaaatcacagattttcttataatgatagtatttaaatgtttataacatagtttaattttatatttattccagatagtatttaatttagtgctttttacccattttgagttgagttgtagtactttatatattctgactttaaatcctttgtcagacacacatattctttctcccaatccatgccttccctattcattctctgtccagagttttttgctaaagatagaattattaatgatacatcaagtagtggaagtgttttgaaaattctttgaagaatgtgagagctacaccttctaccatgaggcttccaaggtaaagatccttcaaataactgtaatggaaactagggagaatgaattatttacaaataagacaaaattaatagctttgggattatttattttttgagacaaaatctcgctcttgttgcccaggctggaatacaatggcgcaatctcagctcactgcagcctccgcctcccggattcaagtgattctcctgccacagcctcctgagtagctgggattgcaggcacctgggcaccatgcctggctaatttttgtatttttagtagagacggggtttcaccatgttggccaggctggtctcaaactcctaacctcaggcgatccacccgcctaagcctcccaaaattttgggatcacaggcgtgagccaccgcgcccggctgctttgggggaatttaatcttagtgtgctgtttagtaatgttaggttttgttttggaggaaactaggcatacaagacatgttaataagactatgtgaataatgaatttaaaaagatcttgagtatatactcataactccagaaataacattaacttgaagctttatttcttgacaaaagctttatgaatgttatgagtttaaaatatgtcaatttaatactatgatttaaaaaacaatagcagatttcgtatgactgtggggacatggaaaaatcaagatcctattgattgctagctctggctcacttattctccggtaatgatactattggatatataccaaaattatataagcaaaaagaaaaaaaataagttttcctggcccaggtcttccattcttctggtccccttactatagtaattctagttactctcatcttattctgaggaaaaaaaaaaaaaccaaaactttttaaacttattttttgacatagggtcttactgtgtcacccaggctggagtacagtggcgtgatcttggctcactggagccctgacctccctaggctcaggtgatcctcccacctcagcctaccgagtagctgagacatggtggcacaggccaccatggcgggctaatttttttatttcttgtagatacagggtttcactatgttgcgcagaatagtctcgaactcctgacctcaagtgatccatccgccttggcctcccagagtgctgcgattacaggcatgaaccacagcgcccagcaaaataaactttctttattttcaggtctagaccatcagatagatttattcaaatattttctgggaacctttatgggtagaacatttaatactgtttagaagacttttaggaatactatagatttcaaatgcatcatttaaaataaataaattccactttctctctcctaggttgtatttaaatttgactgaatatctggatggctaagaacagacatttatcttacacatggaaaactgacgaaacctataagcctatgtgtttgacagtgaagtatgttttatggacttaaatgccacaaacagttaagtccattggcttggagatgacaagcacgagtttctggtatgtctagtgttctcattcactgattcagtcagtacacagataatcactatagagaacttaagaggctggcttatgttatacctaaatttttactttcttgtatacaacaatgctaaaattgagcagattgataactgccagcaaaccatagatttaagataaatgaatgatttacccaaccctaaaattccatgggtaaattttgattcctttattttcaatactgcgttccttataggtcttacatcgcatatcgcaaggatattttatcttattcattcatttcatactctcaaaacaccaaacttcaaaaagttaattattgtcataatgcattattccatgtgtggtgtcaatacattttagcggacaaagaagaaacatgccagttaaaacatttctgctactggattctttattaattatttgagaacgttattttgctagttcttaaggttaagtttttcatcaaagactcaggtacctattattgttccctggtgaaactgaggagaaaagttaatcaaccaggttactcccacagtttgcccgtgtgttatgtatcagttatacaggtatcccaccaagttcaagtcaaaagaaattcctaactttgtatatttctggagctatataaacccctgatttaag

SEQ ID NO: 454766 - DNA, 2364 bp, Homo sapiens
agcctcgcggtgccgcgccctggggcgggcctgcccatggcctgccgggaaatgtagtttctgatgccctgcccgcgccgcctcgccgctcgccggccgggcgccccaagcaactacaacttccatcacgctctgcgaggccttgatctgcaggcttttgcaggggaaggagtggggcgaacatggctgaaggaagccgaggtggccctacgtgtagcggggtgggtggcaggcaggacccagtctccggcagtggcggctgcaactttccagagtatgagcttcccgagctaaatacgcgcgctttccatgtgggcgcctttggggagctgtggcggggccgtctgcgcggggccggggacttgtcgctgagggagccgccggcatccgctctgcctgggagccaggcagctgactccgaccgggaggatgccgcggtggccagggatctggactgcagcctggaggcggcggctgagctgagggcggtgtgcggccttgataaactgaaatgccttgaggacggtgaggatccagaagtcattccggagaatactgacctggtgactttgggggttagaaaaaggttcttggaacatcgggaagaaaccattacaatagatcgagcctgcagacaagaaacattcgtttatgagatggagtcacatgccataggaaaaaagcctgaaaattcagcagacatgattgaagaaggggagcttatcctatctgtgaatatcttgtaccctgttatatttcataagcacaaagaacacaaaccataccaaacaatgctggtgttgggcagtcaaaaactcacacaactgagggattcaattcgatgtgtcagtgacctccagattggtggtgaattcagcaacactcctgaccaagcccctgagcacatcagcaaagacctatacaaatcagccttcttttattttgaaggaacattttataatgataaaagatacccagaatgcagagatttgagcagaactatcattgagtggtcagagtcccatgatagaggctatggaaagtttcagactgctagaatggaagatttcaccttcaatgacttgtgtattaaactgggttttccttacttatactgtcatcagggagactgtgaacatgtcattgtcattactgacataaggcttgtgcatcatgatgactgcttggataggacattgtatcccctccttatcaagaagcattggctatggaccagaaaatgttttgtttgtaaaatgtatacagccagatgggtgacgaacaatgacagttttgcaccagaggacccatgcttcttttgtgatgtttgcttccgaatgctgcactatgattcagaaggcaacaaactgggggaattccttgcttatccttatgttgatcctggaacctttaattaagaatagctacactcacaaaaataccccctcatgaaataactgttctcttggatggttaccttatttctaagaaacgccactgaggaacaggatccactttgaacagtccgctaaagctatcaaaaaaaagtccaaatcacagattttcttataatgatagtatttaaatgtttataacatagtttaattttatatttattccagatagtatttaatttagtgctttttacccattttgagttgagttgtagtactttatatattctgactttaaatcctttgtcagacacacatattctttctcccaatccatgccttccctattcattctctgtccagagttttttgctaaagatagaattattaatgatacatcaagtagtggaagtgttttgaaaattctttgaagaatgtgagagctacaccttctaccatgaggcttccaaggtaaagatccttcaaataactgtaatcccagctacttgggaggctgaggcaggagaatcgcttgaacccgggaagtggaggttgcagtgagcacgatcgtgccattgcactccagcctgagcaacaagagtgaaactctgtctcaaagaaaaaacaacaacaacaaaactgtgattctccatctaactttttacaattatcctttcacaattcaagaaagtgtgaatgcaagtcattactaacagtatctcagtaaaagtagtccagggagcaaatattttctttttaactgggttcccagctagttccattcccttgaattcagtgggcaaagtcactgttcaattaaaaggtttttactcttcttcctttttgaattgtaacttgcttactgaattcaggaattgggtgatcaaaagataactgcttattatagtaagataaccttggaacagaactgtgattaaaaacctgaataataaaaaacacacaagaccca

SEQ ID NO: 454767 - DNA, 856 bp, Homo sapiens
agcctcgcggtgccgcgccctggggcgggcctgcccatggcctgccgggaaatgtagtttctgatgccctgcccgcgccgcctcgccgctcgccggccgggcgccccaagcaactacaacttccatcacgctctgcgaggccttgatctgcaggcttttgcaggggaaggagtggggcgaacatggctgaaggaagccgaggtggccctacgtgtagcggggtgggtggcaggcaggacccagtctccggcagtggcggctgcaactttccagagtatgagcttcccgagctaaatacgcgcgctttccatgtgggcgcctttggggagctgtggcggggccgtctgcgcggggccggggacttgtcgctgagggagccgccggcatccgctctgcctgggagccaggcagctgactccgaccgggaggatgccgcggtggccagggatctggactgcagcctggaggcggcggctgagctgagggcggtgtgcggccttgataaactgaaatgccttgaggacggtgaggatccagaagtcattccggagaatactgacctggtgactttgggggttagaaaaaggttcttggaacatcgggaagaaaccattacaatagatcgagcctgcagacaagaaacattcgtttatgagatggtaattaagagtctcatctttttcacccttttctcttaaaacagtaaaccgacattggctgagggttagtaatgacagtatggtagctttatactggatatgcttagttgaaaacaaactagagaaactcctttgagtctgggaactagtgagagaagaggacccttagaactcaagtgaccacatgtttgactttt

SEQ ID NO: 454768 - DNA, 240 bp, Homo sapiens
ccttgataaactgaaatgccttgaggacggtgaggatccagaagtcattccggagaatactgacctggtgactttggggtatggaggacttggtttttatgacctatttatttaaacattttttcaacattatgttttgaaaagttgaaagtgcagtattgattgttgtctgtatacccaccccttaaattcagctgttcttaatatttgaccatatttactttagccgtgtgtatggga

SEQ ID NO: 454769 - DNA, 404 bp, Homo sapiens
gtctctaaatgaacacttatttattctttgacttttagcacaaagaacacaaaccataccaaacaatgctggtgttgggcagtcaaaaactcacacaactgagggattcaattcgatgtgtcagtgacctccagattggtggtgaattcagcaacactcctgaccaagcccctgagcacatcagcaaagtaaggtgatttcctcccataaaacaaaaggaaataacaagctaagaaaatagcgattactctagctggttcataaatgtcccagtaaatccttttcttctcctgcgggattccatcaaactacactatctcattccttccctttatcaccggaacttttccaaagaagaggctagactctgttttgatttcttcatctctcatttgtttctaaac

SEQ ID NO: 454770 - DNA, 2434 bp, Homo sapiens
agcctcgcggtgccgcgccctggggcgggcctgcccatggcctgccgggaaatgtagtttctgatgccctgcccgcgccgcctcgccgctcgccggccgggcgccccaagcaactacaacttccatcacgctctgcgaggccttgatctgcaggcttttgcaggggaaggagtggggcgaacatggctgaaggaagccgaggtggccctacgtgtagcggggtgggtggcaggcaggacccagtctccggcagtggcggctgcaactttccagagtatgagcttcccgagctaaatacgcgcgctttccatgtgggcgcctttggggagctgtggcggggccgtctgcgcggggccggggacttgtcgctgagggagccgccggcatccgctctgcctgggagccaggcagctgactccgaccgggaggatgccgcggtggccagggatctggactgcagcctggaggcggcggctgagctgagggcggtgtgcggccttgataaactgaaatgccttgaggacggtgaggatccagaagtcattccggagaatactgacctggtgactttgggggttagaaaaaggttcttggaacatcgggaagaaaccattacaatagatcgagcctgcagacaagaaacattcgtttatgagatggagtcacatgccataggaaaaaagcctgaaaattcagcagacatgattgaagaaggggagcttatcctatctgtgaatatcttgtaccctgttatatttcataagcacaaagaacacaaaccataccaaacaatgctggtgttgggcagtcaaaaactcacacaactgagggattcaattcgatgtgtcagtgacctccagattggtggtgaattcagcaacactcctgaccaagcccctgagcacatcagcaaagacctatacaaatcagccttcttttattttgaaggaacattttataatgataaaagatacccagaatgcagagatttgagcagaactatcattgagtggtcagagtcccatgatagaggctatggaaagtttcagactgctagaatggaagatttcaccttcaatgacttgtgtattaaactgggttttccttacttatactgtcatcagggagactgtgaacatgtcattgtcattactgacataaggcttgtgcatcatgatgactgcttggataggacattgtatcccctccttatcaagaagcattggctatggaccagaaaatgttttgtttgtaaaatgtatacagccagatgggtgacgaacaatgacagttttgcaccagaggacccatgcttcttttgtgatgtttgcttccgaatgctgcactatgattcagaaggcaacaaactgggggaattccttgcttatccttatgttgatcctggaacctttaattaagaatagctacactcacaaaaataccccctcatgaaataactgttctcttggatggttaccttatttctaagaaacgccactgaggaacaggatccactttgaacagtccgctaaagctatcaaaaaaaagtccaaatcacagattttcttataatgatagtatttaaatgtttataacatagtttaattttatatttattccagatagtatttaatttagtgctttttacccattttgagttgagttgtagtactttatatattctgactttaaatcctttgtcagacacacatattctttctcccaatccatgccttccctattcattctctgtccagagttttttgctaaagatagaattattaatgatacatcaagtagtggaagtgttttgaaaattctttgaagaatgtgagagctacaccttctaccatgaggcttccaaggttgtatttaaatttgactgaatatctggatggctaagaacagacatttatcttacacatggaaaactgacgaaacctataagcctatgtgtttgacagtgaagtatgttttatggacttaaatgccacaaacagttaagtccattggcttggagatgacaagcacgagtttctggtatgtctagtgttctcattcactgattcagtcagtacacagataatcactatagagaacttaagaggctggcttatgttatacctaaatttttactttcttgtatacaacaatgctaaaattgagcagattgataactgccagcaaaccatagatttaagataaatgaatgatttacccaaccctaaaattccatgggtaaattttgattcctttattttcaatactgcgttccttataggtcttacatcgcatatcgcaaggatattttatcttattcattcatttcatactctcaaaacaccaaacttcaaaaagttaattattgtcataatgcattattccatgtgtggtgtcaatacattttagcggacaaagaagaaacatgccagtt

SEQ ID NO: 454771 - DNA, 554 bp, Homo sapiens
atacactcgagttggacccgattggagcaccactcctgacagcccctgagcacatcagcaaagacctatacaaatcagccttcttttattttgaaggaacattttataatgataaaagatacccagaatgcagagatttgagcagaactatcattgagtggtcagagtcccatgatagaggctatggaaagtttcagactgctagaatggaagatttcaccttcaatgacttgtgtattaaactgggttttccttacttatactgtcatcagggagactgtgaacatgtcattgtcattactgacataaggcttgtgcatcatgatgactgcttggataggacattgtatcccctccttatcaagaagcattggctatggaccagaaaatgttttgtttgtaaaatgtatacagccagatgggtgacgaacaatgacagttttgcaccagaggacccatgcttcttttgtgagtgtagctgccaatgcgcgcatgggcagcaacactcgtaacaagcctctggggagagtgaattgtcatccatttcaccactg

SEQ ID NO: 454772 - DNA, 3862 bp, Homo sapiens
agcctcgcggtgccgcgccctggggcgggcctgcccatggcctgccgggaaatgtagtttctgatgccctgcccgcgccgcctcgccgctcgccggccgggcgccccaagcaactacaacttccatcacgctctgcgaggccttgatctgcaggcttttgcaggggaaggagtggggcgaacatggctgaaggaagccgaggtggccctacgtgtagcggggtgggtggcaggcaggacccagtctccggcagtggcggctgcaactttccagagtatgagcttcccgagctaaatacgcgcgctttccatgtgggcgcctttggggagctgtggcggggccgtctgcgcggggccggggacttgtcgctgagggagccgccggcatccgctctgcctgggagccaggcagctgactccgaccgggaggatgccgcggtggccagggatctggactgcagcctggaggcggcggctgagctgagggcggtgtgcggccttgataaactgaaatgccttgaggacggtgaggatccagaagtcattccggagaatactgacctggtgactttgggggttagaaaaaggttcttggaacatcgggaagaaaccattacaatagatcgagcctgcagacaagaaacattcgtttatgagatggagtcacatgccataggaaaaaagcctgaaaattcagcagacatgattgaagaaggggagcttatcctatctgtgaatatcttgtaccctgttatatttcataaggacctatacaaatcagccttcttttattttgaaggaacattttataatgataaaagatacccagaatgcagagatttgagcagaactatcattgagtggtcagagtcccatgatagaggctatggaaagtttcagactgctagaatggaagatttcaccttcaatgacttgtgtattaaactgggttttccttacttatactgtcatcagggagactgtgaacatgtcattgtcattactgacataaggcttgtgcatcatgatgactgcttggataggacattgtatcccctccttatcaagaagcattggctatggaccagaaaatgttttgtttgtaaaatgtatacagccagatgggtgacgaacaatgacagttttgcaccagaggacccatgcttcttttgtgatgtttgcttccgaatgctgcactatgattcagaaggcaacaaactgggggaattccttgcttatccttatgttgatcctggaacctttaattaagaatagctacactcacaaaaataccccctcatgaaataactgttctcttggatggttaccttatttctaagaaacgccactgaggaacaggatccactttgaacagtccgctaaagctatcaaaaaaaagtccaaatcacagattttcttataatgatagtatttaaatgtttataacatagtttaattttatatttattccagatagtatttaatttagtgctttttacccattttgagttgagttgtagtactttatatattctgactttaaatcctttgtcagacacacatattctttctcccaatccatgccttccctattcattctctgtccagagttttttgctaaagatagaattattaatgatacatcaagtagtggaagtgttttgaaaattctttgaagaatgtgagagctacaccttctaccatgaggcttccaaggtaaagatccttcaaataactgtaatggaaactagggagaatgaattatttacaaataagacaaaattaatagctttgggattatttattttttgagacaaaatctcgctcttgttgcccaggctggaatacaatggcgcaatctcagctcactgcagcctccgcctcccggattcaagtgattctcctgccacagcctcctgagtagctgggattgcaggcacctgggcaccatgcctggctaatttttgtatttttagtagagacggggtttcaccatgttggccaggctggtctcaaactcctaacctcaggcgatccacccgcctaagcctcccaaaattttgggatcacaggcgtgagccaccgcgcccggctgctttgggggaatttaatcttagtgtgctgtttagtaatgttaggttttgttttggaggaaactaggcatacaagacatgttaataagactatgtgaataatgaatttaaaaagatcttgagtatatactcataactccagaaataacattaacttgaagctttatttcttgacaaaagctttatgaatgttatgagtttaaaatatgtcaatttaatactatgatttaaaaaacaatagcagatttcgtatgactgtggggacatggaaaaatcaagatcctattgattgctagctctggctcacttattctccggtaatgatactattggatatataccaaaattatataagcaaaaagaaaaaaaataagttttcctggcccaggtcttccattcttctggtccccttactatagtaattctagttactctcatcttattctgaggaaaaaaaaaaaaaccaaaactttttaaacttattttttgacatagggtcttactgtgtcacccaggctggagtacagtggcgtgatcttggctcactggagccctgacctccctaggctcaggtgatcctcccacctcagcctaccgagtagctgagacatggtggcacaggccaccatggcgggctaatttttttatttcttgtagatacagggtttcactatgttgcgcagaatagtctcgaactcctgacctcaagtgatccatccgccttggcctcccagagtgctgcgattacaggcatgaaccacagcgcccagcaaaataaactttctttattttcaggtctagaccatcagatagatttattcaaatattttctgggaacctttatgggtagaacatttaatactgtttagaagacttttaggaatactatagatttcaaatgcatcatttaaaataaataaattccactttctctctcctaggttgtatttaaatttgactgaatatctggatggctaagaacagacatttatcttacacatggaaaactgacgaaacctataagcctatgtgtttgacagtgaagtatgttttatggacttaaatgccacaaacagttaagtccattggcttggagatgacaagcacgagtttctggtatgtctagtgttctcattcactgattcagtcagtacacagataatcactatagagaacttaagaggctggcttatgttatacctaaatttttactttcttgtatacaacaatgctaaaattgagcagattgataactgccagcaaaccatagatttaagataaatgaatgatttacccaaccctaaaattccatgggtaaattttgattcctttattttcaatactgcgttccttataggtcttacatcgcatatcgcaaggatattttatcttattcattcatttcatactctcaaaacaccaaacttcaaaaagttaattattgtcataatgcattattccatgtgtggtgtcaatacattttagcggacaaagaagaaacatgccagttaaaacatttctgctactggattctttattaattatttgagaacgttattttgctagttcttaaggttaagtttttcatcaaagactcaggtacctattattgttccctggtgaaactgaggagaaaagttaatcaaccaggttactcccacagtttgcccgtgtgttatgtatcagttatacaggtatcccaccaagttcaagtcaaaagaaattcctaactttgtatatttctggagctatataaacccctgatttaag

SEQ ID NO: 454773 - DNA, 2746 bp, Homo sapiens
  misc_feature (699)..(699): n is a, c, g, or t
  misc_feature (999)..(999): n is a, c, g, or t
  misc_feature (2069)..(2069): n is a, c, g, or t
ttctttaaattctacaaagagatacacttcccccaaatacatttactttactgacagcaaagttagtttccatttggaaaagttatcctgtttccaacatcgagttatctctgttgccagaaaatcaaaaggcagccaatccgatttgtaaacctttcctctggcacattgtcaagatctcttgcaaaacgaaattgtcctacagccctcccctcccctgtggctctaagtgcagttctgccccatctaaatattaatattttgcaatcgtgctctttatgagcccctggcagagtggagatacgccacagacgggttgaggagagagtcgtggggaccacctggccagtggctgtggtcttaatggagattgacaagcccaaaggaggtttgcaaataccctgatgcctgcagccggctttgcatccagcagctccctccacagatttacagtggcctctattgtccttgaagagctgcttagaaacaaggttgcaaagctttctccttggggccttgggaaggctggatgaaccctcgcgtctccacctgatagggctgatccaagtgtttctgggtggtggttttccacactggttttatttaaggtctatcaacaggtgctgagtgtgaggcagggaggcaagtgtttttctttttttttttttgagacggagtctcgctctgtcgcccaggccngactgcggactgcagtggcgcaatctcggctcactgcaagctccgcttcccgggttcacgccattctcctgcctcagcctcccgagtagctgggactacaggcgcccgccactgcgcccggctaattttttgtatttttttttagtagagacggggtttcaccttgttagccaggatggtctcgatctcctgacctcatgatccacccgcctcggcctcccaaagtgctgggattacaggcgtgagccaccgcgcccggccgcaagtgtttttctgtgggtgtttcttccttttaaccanctgcaccacatgcttctggtttcaaagcagaaatttcttctctgccactttcatgttttatgtcttttgacttataggagtgccttagttgaaattccatgaaaagggtgtgaagtgtggatcaccttgcttagactctgttaggaggttgagtgcttgtgcaggctgggagagcatgcacttcttttcaggaggcaggtgaagggagcaggtgggatgaggcagaagactggccagaaagaacacttttctccccatgagttttgcagttagacagaagtagtaaggacgattgtgaagttcttgaaagtgagaagagagaacatgttcctttgaaattaaaactcagtttttcctgatttttcacgttagctaaaacgtgccaggaaacgggcttttcctgatttctttttttccctagtacaataacataatgactaaatttggaaaagtactttgcagttttcaaagcactttgttattcacagtaactgcagagatccccccgttttagatgagaagggaaactgaggtgtgaagaaggaaaggaacaggagagaagtgacaaagatgagtaaagtattggtaatttcttttctctgggagttctaacattctaacaggcttgtagtttaagacgtttctagatagcagattctcacacctaactcactatattttccaaacttatctaactataagaatccgctggtgtgcttgttcatatacagattcttaggcccatcttctagttattctgatttcagttggtctggggtgatctaggagtctgctttttttaacaaggtcatgtggggattcttatctcttggcatgtttgggaaattttacatagccggcagctgaagtgcacatggaaataagttgtccaaggtcacgcaatctgaactccctgatccccacctggtgtctctggtccctgagcccacatccccctaccacccactgttccacagctgccttcccagggacacagagtttgtgatcaatactgaataattctgccacgtctttattgtcatgccttcatcacctactacgtatgaagntgtccagaaacaggagggatttaagggtgagggagagaatgaagaagacagacacaggcataagagacaaaaagaaacctcaatgttattaaaaattcaagccaggtgtaggggtgcacacctgtagccctagttactagggaggctgagacgggaggattgcttgagcccaagagttcaaggccagtctgggcaacatagcgagcctgcctcaaaaaagaaaaaaaaatcactacaaccatagaggtgcagtaaattctaaatctaattgccatattaagaggcattcattctccattcccttcataaaacctacttattaatgccagtcacactaaatattcataaccaataggctgtgcactagtacagaagtctcaaaagtggagagtagccaagcacagtggctcacacctgtaatcccaacactttgggaggccaattcaggagcattgcttgagcccaggagttcgagaccagcctaggcaacatggtgacaccatgtctctacaaaaaattttaaaaattagccaggcatagtggcacatgcctatagtcccagctatgaagggaggctgaggtgggaggatcacttgcgcccaggagttcaaggctgcaatgagctatgatcatgccactgcactgcagcctgggcgacagagcaagactctcttttt

SEQ ID NO: 454774 - DNA, 3032 bp, Homo sapiens
aggtgaaatcttgctctgtcacccaggctggagtgcagtgtcacaatcttggctcactgcaacctccacttcccaggtttaagtgattctcccacctcagcctcctgagtagctgggattacaggttcagggagcaagtttccgaggttggaaagaagtgacttcactgtttaacaaagatgatgagcagcatctcctggaaagatgtaaatctcccaagtccaaaggaactaacttacgattaaaagaagagttgaaggcagagaagaaatctggattttgggacaatttggttttaaaacagaatatacagtctaaaaaaccagatgaaattgaaggttgggagcctccaaaacttgctcttgaagacatatcggctgaccctgaggacaccgtgggtggccacccatcctggtcaggctgggaggatgacgccaagggctcgaccaagtacaccagcctggccagctctgccaacagctccaggtggagcctgcgcgcggcagggaggctggtgagcatccgacggcagagtaaaggccacctgacagatagcccggaggaggcggagtgaggggggctgcgtggcaagtgtgccccgacatggtggccttttatgagtataccatgtagttgttgagtcttttccgcgttagaaagaatagagagtctactttttgcctatatttgatatttggacctctgtttctttatttaatgaactctcacacacactgtgactccttggtgaacacgtgcagggattgtacatttgattgccttattgcagaaatattcacctatcagtccatgttttgcagaaactggagatgtgaatttatgatgctctcccataatacagcagtaatgatttgcagtttctcacaaaatgattttcatgctgctctgtgttgtagttctgtttcagaacttccgtacctttttcttgtatgtagcacgtataaatgcagctgtcatgcagttcttttcttttgctagaaaattagtcaggaggtaagatgaatcttccaaagttatgttaaattttgtttaacttgacaaattaaactttgttcttattaaacaaatacgtaaacaaatactggaaaagcaaaggttatatttgggagtaaaatgtatcttaaaatgcatgttcatcttttgctgagggaggaatagcttcttgtatgtccactggatagtaacagtggttcttttttggaattttatttttacctcttttgaacttctaaatcggtccctttattttcttaaaacatttgctctcttttttgtttacagattaaagaagtatggatcaattttagtcagttgataatttcatttaggaaacattgtcttgctcattatagagagttaagactgtgcataaaatactgaagtgcctcttttttattaggctcatatgtttgttcttgcaaagcgagatgcctattgtgattggtgttagatctgtaagaagctgtgttttttccacaagaataatcgacgaccggtttgagagcatctctcgcgttctttttctgtctgcttactgtccttgacaatgtgatcctgcacagtatcaggtgccagttatgcgtccctggaaggttggctcttatcagcaagtcctgcagatatctcttagataaaagtggtttgaaagaaaaggtatatttttcttttttgtttaaaagtaaaataaaacctccagttacactgtgcattcccctcacgtaaaaacaagacaaaaaccctttcctgagttgctcggcatgcactcctgtgctgtttcatgcatgtggatgttccttccgtttgttcctgtggaataactgagtgtgcctgatggcagaacacactgcagtgttatcagtgtctgcatgttttttaatagaacaggtttacttgatctgtcatctgttatgcaaaaaacagcaattacttttgcatccatctagctaaatctataatctgtgtcaatcacttatacctatcaatcatccgtatctattcacctgtcctctatgtctgtcttctctcagtctacatccatctagccttctgtcaatcatctacttttttttttaatagaacaagaagtttacttatcaagtcttgaaagggggacatgtttcaattggtgttcaaacaaaaattccagcttgtattagaaccttgaaatggtgaagttgtggaggttttctttgttccataatacagagacaagttcataatttttagtataacagctaagttgacaaattctaagtttcctcaggtaaatagtcgtaactgtccttttccctagagaagtgcttgctgggatagtaaaaacatacaccatttcatgacttctgcaaatactttccagcggaagtcagtgtaggtttgtttttggctaacatggtcttgctgcgcaggaatgtaaacactgtgtttgaaactctggaaatcacgtgtgtggggagatggggacgcttcccatgttgtggggagctctgtggctgtgatggctgcagttgccgtgcctctgttggaacgctaagtgcctgcaactcacgtcaatcatagaattgtgacgcacagttggcaaaatagttctttatgctatttctcaaaatttgaggacaaacccagattgggattggaatatgcactgtaaatcaaatttttcttatctacaaagactaatgtaaaaatgattttttcttctgtgcctgattaaattaactgtggtttttaatataaatatttattggtgtgctttgggagaaaaattatcttttcttgaaagaagttatcaaagcaaatttattatcttcacaagttaatgggagaatgtggttttgattctgggtgtttgaattgtgtaaacacacagcttccttgtgtgaagagagttgtcctgtgctccttctactgtactttttttattttttaataggaaagtgatgtgcttcagagaagggttcctccttaatgttgaggttttttaaaaataaaaatactgtttttaagctctttcc

SEQ ID NO: 454775 - DNA, 3043 bp, Homo sapiens
agccgcaggcagagcgtccggcggccgggagggacgcggagccacagcccgacgcacggacggagggacgccggagcccgcctgaccatgtggaagctgggccggggccgagtgctgctggacgagccccccgaggaggaggacggcctgcgtggggggccgccaccggccgccgccgccgccgcccaggttcagggagcaagtttccgaggttggaaagaagtgacttcactgtttaacaaagatgatgagcagcatctcctggaaagatgtaaatctcccaagtccaaaggaactaacttacgattaaaagaagagttgaaggcagagaagaaatctggattttgggacaatttggttttaaaacagaatatacagtctaaaaaaccagatgaaattgaaggttgggagcctccaaaacttgctcttgaagacatatcggctgaccctgaggacaccgtgggtggccacccatcctggtcaggctgggaggatgacgccaagggctcgaccaagtacaccagcctggccagctctgccaacagctccaggtggagcctgcgcgcggcagggaggctggtgagcatccgacggcagagtaaaggccacctgacagatagcccggaggaggcggagtgaggggggctgcgtggcaagtgtgccccgacatggtggccttttatgagtataccatgtagttgttgagtcttttccgcgttagaaagaatagagagtctactttttgcctatatttgatatttggacctctgtttctttatttaatgaactctcacacacactgtgactccttggtgaacacgtgcagggattgtacatttgattgccttattgcagaaatattcacctatcagtccatgttttgcagaaactggagatgtgaatttatgatgctctcccataatacagcagtaatgatttgcagtttctcacaaaatgattttcatgctgctctgtgttgtagttctgtttcagaacttccgtacctttttcttgtatgtagcacgtataaatgcagctgtcatgcagttcttttcttttgctagaattgacaaattaaactttgttcttattaaacaaatacgtaaacaaatactggaaaagcaaaggttatatttgggagtaaaatgtatcttaaaatgcatgttcatcttttgctgagggaggaatagcttcttgtatgtccactggatagtaacagtggttcttttttggaattttatttttacctcttttgaacttctaaatcggtccctttattttcttaaaacatttgctctcttttttgtttacagattaaagaagtatggatcaattttagtcagttgataatttcatttaggaaacattgtcttgctcattatagagagttaagactgtgcataaaatactgaagtgcctcttttttattaggctcatatgtttgttcttgcaaagcgagatgcctattgtgattggtgttagatctgtaagaagctgtgttttttccacaagaataatcgacgaccggtttgagagcatctctcgcgttctttttctgtctgcttactgtccttgacaatgtgatcctgcacagtatcaggtgccagttatgcgtccctggaaggttggctcttatcagcaagtcctgcagatatctcttagataaaagtggtttgaaagaaaaggtatatttttcttttttgtttaaaagtaaaataaaacctccagttacactgtgcattcccctcacgtaaaaacaagacaaaaaccctttcctgagttgctcggcatgcactcctgtgctgtttcatgcatgtggatgttccttccgtttgttcctgtggaataactgagtgtgcctgatggcagaacacactgcagtgttatcagtgtctgcatgttttttaatagaacaggtttacttgatctgtcatctgttatgcaaaaaacagcaattacttttgcatccatctagctaaatctataatctgtgtcaatcacttatacctatcaatcatccgtatctattcacctgtcctctatgtctgtcttctctcagtctacatccatctagccttctgtcaatcatctacttttttttttaatagaacaagaagtttacttatcaagtcttgaaagggggacatgtttcaattggtgttcaaacaaaaattccagcttgtattagaaccttgaaatggtgaagttgtggaggttttctttgttccataatacagagacaagttcataatttttagtataacagctaagttgacaaattctaagtttcctcaggtaaatagtcgtaactgtccttttccctagagaagtgcttgctgggatagtaaaaacatacaccatttcatgacttctgcaaatactttccagcggaagtcagtgtaggtttgtttttggctaacatggtcttgctgcgcaggaatgtaaacactgtgtttgaaactctggaaatcacgtgtgtggggagatggggacgcttcccatgttgtggggagctctgtggctgtgatggctgcagttgccgtgcctctgttggaacgctaagtgcctgcaactcacgtcaatcatagaattgtgacgcacagttggcaaaatagttctttatgctatttctcaaaatttgaggacaaacccagattgggattggaatatgcactgtaaatcaaatttttcttatctacaaagactaatgtaaaaatgattttttcttctgtgcctgattaaattaactgtggtttttaatataaatatttattggtgtgctttgggagaaaaattatcttttcttgaaagaagttatcaaagcaaatttattatcttcacaagttaatgggagaatgtggttttgattctgggtgtttgaattgtgtaaacacacagcttccttgtgtgaagagagttgtcctgtgctccttctactgtactttttttattttttaataggaaagtgatgtgcttcagagaagggttcctccttaatgttgaggttttttaaaaataaaaatactgtttttaagctctttcc

SEQ ID NO: 454776 - DNA, 3271 bp, Homo sapiens
agccgcaggcagagcgtccggcggccgggagggacgcggagccacagcccgacgcacggacggagggacgccggagcccgcctgaccatgtggaagctgggccggggccgagtgctgctggacgagccccccgaggaggaggacggcctgcgtggggggccgccaccggccgccgccgccgccgcccaggttcagggagcaagtttccgaggttggaaagaagtgacttcactgtttaacaaagatgatgagcagcatctcctggaaagatgtaaatctcccaagtccaaaggaactaacttacgattaaaagaagagttgaaggcagagaagaaatctggattttgggacaatttggttttaaaacagaatatacagtctaaaaaaccagatgaaattgaaggttgggagcctccaaaacttgctcttgaagacatatcggctgaccctgaggacaccgtgggtggccacccatcctggtcaggctgggaggatgacgccaagggctcgaccaagtacaccagcctggccagctctgccaacagctccaggtggagcctgcgcgcggcagggaggctggtgagcatccgacggcagagtaaaggccacctgacagatagcccggaggaggcggagtgaggggggctgcgtggcaagtgtgccccgacatggtggccttttatgagtataccatgtagttgttgagtcttttccgcgttagaaagaatagagagtctactttttgcctatatttgatatttggacctctgtttctttatttaatgaactctcacacacactgtgactccttggtgaacacgtgcagggattgtacatttgattgccttattgcagaaatattcacctatcagtccatgttttgcagaaactggagatgtgaatttatgatgctctcccataatacagcagtaatgatttgcagtttctcacaaaatgattttcatgctgctctgtgttgtagttctgtttcagaacttccgtacctttttcttgtatgtagcacgtataaatgcagctgtcatgcagttcttttcttttgctagaaaattagtcaggaggtaagatgaatcttccaaagttatgttaaattttgtttaacttgacaaattaaactttgttcttattaaacaaatacgtaaacaaatactggaaaagcaaaggttatatttgggagtaaaatgtatcttaaaatgcatgttcatcttttgctgagggaggaatagcttcttgtatgtccactggatagtaacagtggttcttttttggaattttatttttacctcttttgaacttctaaatcggtccctttattttcttaaaacatttgctctcttttttgtttacagattaaagaagtatggatcaattttagtcagttgataatttcatttaggaaacattgtcttgctcattatagagagttaagactgtgcataaaatactgaagtgcctcttttttattaggctcatatgtttgttcttgcaaagcgagatgcctattgtgattggtgttagatctgtaagaagctgtgttttttccacaagaataatcgacgaccggtttgagagcatctctcgcgttctttttctgtctgcttactgtccttgacaatgtgatcctgcacagtatcaggtgccagttatgcgtccctggaaggttggctcttatcagcaagtcctgcagatatctcttagataaaagtggtttgaaagaaaaggtatatttttcttttttgtttaaaagtaaaataaaacctccagttacactgtgcattcccctcacgtaaaaacaagacaaaaaccctttcctgagttgctcggcatgcactcctgtgctgtttcatgcatgtggatgttccttccgtttgttcctgtggaataactgagtgtgcctgatggcagaacacactgcagtgttatcagtgtctgcatgttttttaatagaacaggtttacttgatctgtcatctgttatgcaaaaaacagcaattacttttgcatccatctagctaaatctataatctgtgtcaatcacttatacctatcaatcatccgtatctattcacctgtcctctatgtctgtcttctctcagtctacatccatctagccttctgtcaatcatctacttttttttttaatagaacaagaagtttacttatcaagtcttgaaagggggacatgtttcaattggtgttcaaacaaaaattccagcttgtattagaaccttgaaatggtgaagttgtggaggttttctttgttccataatacagagacaagttcataatttttagtataacagctaagttgacaaattctaagtttcctcaggtaaatagtcgtaactgtccttttccctagagaagtgcttgctgggatagtaaaaacatacaccatttcatgacttctgcaaatactttccagcggaagtcagtgtaggtttgtttttggctaacatggtcttgctgcgcaggaatgtaaacactgtgtttgaaactctggaaatcacgtgtgtggggagatggggacgcttcccatgttgtggggagctctgtggctgtgatggctgcagttgccgtgcctctgttggaacgctaagtgcctgcaactcacgtcaatcatagaattgtgacgcacagttggcaaaatagttctttatgctatttctcaaaatttgaggacaaacccagattgggattggaatatgcactgtaaatcaaatttttcttatctacaaagactaatgtaaaaatgattttttcttctgtgcctgattaaattaactgtggtttttaatataaatatttattggtgtgctttgggagaaaaattatcttttcttgaaagaagttatcaaagcaaatttattatcttcacaagttaatgggagaatgtggttttgattctgggtgtttgaattgtgtaaacacacagcttccttgtgtgaagagagttgtcctgtgctccttctactgtactttttttattttttaataggaaagtgatgtgcttcagagaagggttcctccttaatgttgaggttttttaaaaataaaaatactgtttttaagctctttccttattggtttgcatgattattggcatctgcttacgatggctttaatcactcagagctaatggcacctttcctatttagcctcattttagaatgcagtcaacacatgtagacttttcacaaataaatgaacaacttcaaccttggttttcaagatgtgtcttctgcgtatttgaa

SEQ ID NO: 454777 - DNA, 3097 bp, Homo sapiens
agccgcaggcagagcgtccggcggccgggagggacgcggagccacagcccgacgcacggacggagggacgccggagcccgcctgaccatgtggaagctgggccggggccgagtgctgctggacgagccccccgaggaggaggacggcctgcgtggggggccgccaccggccgccgccgccgccgcccaggttcagggagcaagtttccgaggttggaaagaagtgacttcactgtttaacaaagatgatgagcagcatctcctggaaagatgtaaatctcccaagtccaaaggaactaacttacgattaaaagaagagttgaaggcagagaagaaatctggattttgggacaatttggttttaaaacagaatatacagtctaaaaaaccagatgaaattgaaggttgggagcctccaaaacttgctcttgaagacatatcggctgaccctgaggacaccgtgggtggccacccatcctggtcaggctgggaggatgacgccaagggctcgaccaagtacaccagcctggccagctctgccaacagctccaggtggagcctgcgcgcggcagggaggctggtgagcatccgacggcagagtaaaggccacctgacagatagcccggaggaggcggagtgaggggggctgcgtggcaagtgtgccccgacatggtggccttttatgagtataccatgtagttgttgagtcttttccgcgttagaaagaatagagagtctactttttgcctatatttgatatttggacctctgtttctttatttaatgaactctcacacacactgtgactccttggtgaacacgtgcagggattgtacatttgattgccttattgcagaaatattcacctatcagtccatgttttgcagaaactggagatgtgaatttatgatgctctcccataatacagcagtaatgatttgcagtttctcacaaaatgattttcatgctgctctgtgttgtagttctgtttcagaacttccgtacctttttcttgtatgtagcacgtataaatgcagctgtcatgcagttcttttcttttgctagaaaattagtcaggaggtaagatgaatcttccaaagttatgttaaattttgtttaacttgacaaattaaactttgttcttattaaacaaatacgtaaacaaatactggaaaagcaaaggttatatttgggagtaaaatgtatcttaaaatgcatgttcatcttttgctgagggaggaatagcttcttgtatgtccactggatagtaacagtggttcttttttggaattttatttttacctcttttgaacttctaaatcggtccctttattttcttaaaacatttgctctcttttttgtttacagattaaagaagtatggatcaattttagtcagttgataatttcatttaggaaacattgtcttgctcattatagagagttaagactgtgcataaaatactgaagtgcctcttttttattaggctcatatgtttgttcttgcaaagcgagatgcctattgtgattggtgttagatctgtaagaagctgtgttttttccacaagaataatcgacgaccggtttgagagcatctctcgcgttctttttctgtctgcttactgtccttgacaatgtgatcctgcacagtatcaggtgccagttatgcgtccctggaaggttggctcttatcagcaagtcctgcagatatctcttagataaaagtggtttgaaagaaaaggtatatttttcttttttgtttaaaagtaaaataaaacctccagttacactgtgcattcccctcacgtaaaaacaagacaaaaaccctttcctgagttgctcggcatgcactcctgtgctgtttcatgcatgtggatgttccttccgtttgttcctgtggaataactgagtgtgcctgatggcagaacacactgcagtgttatcagtgtctgcatgttttttaatagaacaggtttacttgatctgtcatctgttatgcaaaaaacagcaattacttttgcatccatctagctaaatctataatctgtgtcaatcacttatacctatcaatcatccgtatctattcacctgtcctctatgtctgtcttctctcagtctacatccatctagccttctgtcaatcatctacttttttttttaatagaacaagaagtttacttatcaagtcttgaaagggggacatgtttcaattggtgttcaaacaaaaattccagcttgtattagaaccttgaaatggtgaagttgtggaggttttctttgttccataatacagagacaagttcataatttttagtataacagctaagttgacaaattctaagtttcctcaggtaaatagtcgtaactgtccttttccctagagaagtgcttgctgggatagtaaaaacatacaccatttcatgacttctgcaaatactttccagcggaagtcagtgtaggtttgtttttggctaacatggtcttgctgcgcaggaatgtaaacactgtgtttgaaactctggaaatcacgtgtgtggggagatggggacgcttcccatgttgtggggagctctgtggctgtgatggctgcagttgccgtgcctctgttggaacgctaagtgcctgcaactcacgtcaatcatagaattgtgacgcacagttggcaaaatagttctttatgctatttctcaaaatttgaggacaaacccagattgggattggaatatgcactgtaaatcaaatttttcttatctacaaagactaatgtaaaaatgattttttcttctgtgcctgattaaattaactgtggtttttaatataaatatttattggtgtgctttgggagaaaaattatcttttcttgaaagaagttatcaaagcaaatttattatcttcacaagttaatgggagaatgtggttttgattctgggtgtttgaattgtgtaaacacacagcttccttgtgtgaagagagttgtcctgtgctccttctactgtactttttttattttttaataggaaagtgatgtgcttcagagaagggttcctccttaatgttgaggttttttaaaaataaaaatactgtttttaagctctttcc

SEQ ID NO: 454778 - DNA, 1670 bp, Homo sapiens
  misc_feature (1670)..(1670): n is a, c, g, or t
agccgcaggcagagcgtccggcggccgggagggacgcggagccacagcccgacgcacggacggagggacgccggagcccgcctgaccatgtggaagctgggccggggccgagtgctgctggacgagccccccgaggaggaggacggcctgcgtggggggccgccaccggccgccgccgccgccgcccaggttcagggagcaagtttccgaggttggaaagaagtgacttcactgtttaacaaagatgatgagcagcatctcctggaaagatgtaaatctcccaagtccaaaggaactaacttacgattaaaagaagagttgaaggcagagaagaaatctggattttgggacaatttggttttaaaacagaatatacagtctaaaaaaccagatgaaattgaaggttgggagcctccaaaacttgctcttgaagacatatcggctgaccctgaggacaccgtgggtggccacccatcctggtcaggctgggaggatgacgccaagggctcgaccaagtacaccagcctggccagctctgccaacagctccaggtggagcctgcgcgcggcagggaggctggtgagcatccgacggcagagtaaaggccacctgacagatagcccggaggaggcggagtgaggggggctgcgtggcaagtgtgccccgacatggtggccttttatgagtataccatgtagttgttgagtcttttccgcgttagaaagaatagagagtctactttttgcctatatttgatatttggacctctgtttctttatttaatgaactctcacacacactgtgactccttggtgaacacgtgcagggattgtacatttgattgccttattgcagaaatattcacctatcagtccatgttttgcagaaactggagatgtgaatttatgatgctctcccataatacagcagtaatgatttgcagtttctcacaaaatgattttcatgctgctctgtgttgtagttctgtttcagaacttccgtacctttttcttgtatgtagcacgtataaatgcagctgtcatgcagttcttttcttttgctagaaaattagtcaggaggtaagatgaatcttccaaagttatgttaaattttgtttaacttgacaaattaaactttgttcttattaaacaaatacgtaaacaaaaaaaaaaaaaaaaaaaaaaaaaaaaattttggcggcgcgccccagggcccccgaaaaaaagcttcttaagaacacaatgcggtgtgaggagacagcgggacccaagagagaaacgtgcacacctgggccaaaacgggtaccacgagagaaaaccggggcacaacacaagagcgcggggatctctcccccagttaaaaaaaaaaaggcgcgcgggggagaacaccacgcagagctctctcggtggaagaaccaattcccggcaagagaggcggagaaccaccagaaggaggaccacataagcggggggcgcatcataaccaccgaaggggggatctccccagagagagcagagccgcagcatactacacaaaatatgaccccccgccgcagcagagagagacaacggaagaagacgagcaaacagcagacaccaagaagaagaacaacacgaagacgaatcaaaaagcaagacaaaagacaaagacggaacagccggaaagagaan

SEQ ID NO: 454779 - DNA, 1516 bp, Homo sapiens
gagcgggtgagaggagcgggacacgcggaggaggtaaggaaggggtaggccctctccgggatctctgtcccccagtcaccttcctgcgacccttcctgggaggggcgtcctgggcggtgggggaaggtgggaggggcgggcggttacctcatcgccgcctccgggaggccccgctcgctcgcgccggcggctggggcggcgactccaggcgcggaagcgagagaaggatagaggcacagaggctccgggaggcagcgctgccccccgcgccccgcaccgctgcgggacccgcgccgcgagaggggcggacttcggcgcctcgcgcgtccgccggcgcctgggttggcgctgcggggcggaggcggtgtctgagcgccgctccggctctgctctctctcgagcttcggcacccgcccgagccgctcgcgcgcccgccacctgtctgcccactcggctgtctgtctgccctcccgccgccagctcctgcctcgggcctgccctctccggtctcggtgctccgaggggcgacgagaagcgcgacggggccgtggcgcaccgggcagggcgcgcggggcgcacggcctgggggcgcacggtgcggcgccggcccatgaggctttccagcgcggggagcggcagcgccggccggccatggggggtagcctgcgggtggccgttctaggcgccccgggcgtgggcaagacggccatcatccgccagttcctgttcggtgactaccccgagcgccaccggcccacggacgggccgcgcctctaccgacccgcggtgctgctcgacggcgccgtctacgacttgagcatccgcgacggcgacgtcgctggccccggctcgagccccgggggtccggaggagtggccagacgctaaggactggagcttgcaggacacggacgccttcgtgctcgtctacgacatctgcagcccggacagtttcgactacgtgaaggccctgcggcagcgcatcgcggagaccaggccggcgggcgcgcccgaagcgcccatcctcgtggtaggcaacaagcgggacaggcagcggctgcgcttcggaccgcggcgcgcgctggccgccctagtgcgcaggggctggcgctgcggctacctcgagtgctccgccaagtacaactggcacgtgctgcgtctcttccgcgagctgctgcgctgcgctctggtgcgcgcgcgccctgcacacccggccctgcgcctgcagggggcgctgcatcccgcgcgctgcagcctcatgtgacccgatcggacagtgccatccatgggccccaccttgtgactgggacaatcagggacctggattggacgggatcgcccaacctccattggagatgaccagtcctttctgggacctcaatgggtcacaatcccattggatggaaaggacttggctatgaacttgactggaaacacgcagcctgctcctggagcttcactggacatattctttatgccacacctaccacgggataataaaagggaaaataatttga

SEQ ID NO: 454780 - DNA, 1146 bp, Homo sapiens
agtcttagaggccgtggtaagcaccgagagcatctagggaggagagcggcctgagccgagttggggaaagctgaaaagaggaagattcggggagtggccagacgctaaggactggagcttgcaggacacggacgccttcgtgctcgtctacgacatctgcagcccggacagtttcgactacgtgaaggccctgcggcagcgcatcgcggagaccaggtaggggcccggcagttctggcggtggggagctaggacaggtctggcagggcctttgcctgaggagagtgtgtagggtctcccaacgtcgtgggccgggtcttaggccttcgcccgtgggaaggtcttaagctgtatgtgctctttggcccacatgggcctggggtttcgttggggcggcggggggggcggtgtctctggccgtaggaagggaatgcgcctgcgtgtgtatacccactgggggaattctccggccgtggggtccccgcgtctctcatctccattcggcccccaggccggcgggcgcgcccgaagcgcccatcctcgtggtaggcaacaagcgggacaggcagcggctgcgcttcggaccgcggcgcgcgctggccgccctagtgcgcaggggctggcgctgcggctacctcgagtgctccgccaagtacaactggcacgtgctgcgtctcttccgcgagctgctgcgctgcgctctggtgcgcgcgcgccctgcacacccggccctgcgcctgcagggggcgctgcatcccgcgcgctgcagcctcatgtgacccgatcggacagtgccatccatgggccccaccttgtgactgggacaatcagggacctggattggacgggatcgcccaacttcactgggactggacagggaagtctccgccctgattggatgaggaaagctccaacccagtctcctaagcgactggcccccttttgaacctcattggacccaaccaggtcccaagctccattggagatgaccagtcctttctgggacctcaatgggtcacaatcccattggatggaaaggacttggctatgaacttgactggaaacacgcagcctgctcctggagcttcactggacatattctttatgccacacctaccacgggataataaaagggaaaataatttga

SEQ ID NO: 454781 - DNA, 458 bp, Homo sapiens
gtagccgcagcgccagcccctgcgcactagggcggccagcgcgcgccgcggtccggggcgctgcatcccgcgcgctgcagcctcatgtgacccgatcggacagtgccatccatgggccccaccttgtgactgggacaatcagggacctggattggacgggatcgcccaacttcactgggactggacagggaagtctccgccctgattggatgaggaaagctccaacccagtctcctaagcgactggcccccttttgaacctcattggacccaaccaggtcccaagctccattggagatgaccagtcctttctgggacctcaatgggtcacaatcccattggatggaaaggacttggctatgaacttgactggaaacacgcagcctgctcctggagcttcactggacatattctttatgccacacctaccacgggataataaaagggaaaataatttga

SEQ ID NO: 454782 - DNA, 1631 bp, Homo sapiens
gagcgggtgagaggagcgggacacgcggaggaggtaaggaaggggtaggccctctccgggatctctgtcccccagtcaccttcctgcgacccttcctgggaggggcgtcctgggcggtgggggaaggtgggaggggcgggcggttacctcatcgccgcctccgggaggccccgctcgctcgcgccggcggctggggcggcgactccaggcgcggaagcgagagaaggatagaggcacagaggctccgggaggcagcgctgccccccgcgccccgcaccgctgcgggacccgcgccgcgagaggggcggacttcggcgcctcgcgcgtccgccggcgcctgggttggcgctgcggggcggaggcggtgtctgagcgccgctccggctctgctctctctcgagcttcggcacccgcccgagccgctcgcgcgcccgccacctgtctgcccactcggctgtctgtctgccctcccgccgccagctcctgcctcgggcctgccctctccggtctcggtgctccgaggggcgacgagaagcgcgacggggccgtggcgcaccgggcagggcgcgcggggcgcacggcctgggggcgcacggtgcggcgccggcccatgaggctttccagcgcggggagcggcagcgccggccggccatggggggtagcctgcgggtggccgttctaggcgccccgggcgtgggcaagacggccatcatccgccagttcctgttcggtgactaccccgagcgccaccggcccacggacgggccgcgcctctaccgacccgcggtgctgctcgacggcgccgtctacgacttgagcatccgcgacggcgacgtcgctggccccggctcgagccccgggggtccggaggagtggccagacgctaaggactggagcttgcaggacacggacgccttcgtgctcgtctacgacatctgcagcccggacagtttcgactacgtgaaggccctgcggcagcgcatcgcggagaccaggccggcgggcgcgcccgaagcgcccatcctcgtggtaggcaacaagcgggacaggcagcggctgcgcttcggaccgcggcgcgcgctggccgccctagtgcgcaggggctggcgctgcggctacctcgagtgctccgccaagtacaactggcacgtgctgcgtctcttccgcgagctgctgcgctgcgctctggtgcgcgcgcgccctgcacacccggccctgcgcctgcagggggcgctgcatcccgcgcgctgcagcctcatgtgacccgatcggacagtgccatccatgggccccaccttgtgactgggacaatcagggacctggattggacgggatcgcccaacttcactgggactggacagggaagtctccgccctgattggatgaggaaagctccaacccagtctcctaagcgactggcccccttttgaacctcattggacccaaccaggtcccaagctccattggagatgaccagtcctttctgggacctcaatgggtcacaatcccattggatggaaaggacttggctatgaacttgactggaaacacgcagcctgctcctggagcttcactggacatattctttatgccacacctaccacgggataataaaagggaaaataatttga

SEQ ID NO: 454783 - DNA, 1810 bp, Homo sapiens
gagcgggtgagaggagcgggacacgcggaggaggtaaggaaggggtaggccctctccgggatctctgtcccccagtcaccttcctgcgacccttcctgggaggggcgtcctgggcggtgggggaaggtgggaggggcgggcggttacctcatcgccgcctccgggaggccccgctcgctcgcgccggcggctggggcggcgactccaggcgcggaagcgagagaaggatagaggcacagaggctccgggaggcagcgctgccccccgcgccccgcaccgctgcgggacccgcgccgcgagaggggcggacttcggcgcctcgcgcgtccgccggcgcctgggttggcgctgcggggcggaggcggtgtctgagcgccgctccggctctgctctctctcgagcttcggcacccgcccgagccgctcgcgcgcccgccacctgtctgcccactcggctgtctgtctgccctcccgccgccagctcctgcctcgggcctgccctctccggtctcggtgctccgaggggcgacgagaagcgcgacggggccgtggcgcaccgggcagggcgcgcggggcgcacggcctgggggcgcacggtgcggcgccggcccatgaggctttccagcgcggggagcggcagcgccggccggccatggggggtagcctgcgggtggccgttctaggcgccccgggcgtgggcaagacggccatcatccgccagttcctgttcggtgactaccccgagcgccaccggcccacggacgggccgcgcctctaccgacccgcggtgctgctcgacggcgccgtctacgacttgagcatccgcgacggcgacgtcgctggccccggctcgagccccgggggtccggaggagtggccagacgctaaggactggagcttgcaggacacggacgccttcgtgctcgtctacgacatctgcagcccggacagtttcgactacgtgaaggccctgcggcagcgcatcgcggagaccaggtaggggcccggcagttctggcggtggggagctaggacaggtctggcagggcctttgcctgaggagagtgtgtagggtctcccaacgtcgtgggccgggtcttaggccttcgcccgtgggaaggtcttaagctgtatgtgctctttggcccacatgggcctggggtttcgttggggcggcggggggggcggtgtctctggccgtaggaagggaatgcgcctgcgtgtgtatacccactgggggaattctccggccgtggggtccccgcgtctctcatctccattcggcccccaggccggcgggcgcgcccgaagcgcccatcctcgtggtaggcaacaagcgggacaggcagcggctgcgcttcggaccgcggcgcgcgctggccgccctagtgcgcaggggctggcgctgcggctacctcgagtgctccgccaagtacaactggcacgtgctgcgtctcttccgcgagctgctgcgctgcgctctggtgcgcgcgcgccctgcacacccggccctgcgcctgcagggggcgctgcatcccgcgcgctgcagcctcatgtgacccgatcggacagtgccatccatgggccccaccttgtgactgggacaatcagggacctggattggacgggatcgcccaacctccattggagatgaccagtcctttctgggacctcaatgggtcacaatcccattggatggaaaggacttggctatgaacttgactggaaacacgcagcctgctcctggagcttcactggacatattctttatgccacacctaccacgggataataaaagggaaaataatttga

SEQ ID NO: 454784 - DNA, 522 bp, Homo sapiens
gcaggagaatcgcttcaacctgggaggcacaggctgcagtgatctgagatcatgccacttccctccagcctgggtgacaaagaaagactctgtttcaaacaaaacaaaacaaaacaaaacagaaggatgggaggatggagggaatcatggtggacaggaggcaggactagactgcagctccagacaaagcagcatctggaagcttccatggtgaattttagctccagatcaactgcaagaataaatcagcaattctgaggggacccacagaccctctgaaggaagcggattgctcctgtagggcccagaagacaccccaaatactgtgagtgccccaactgcggaagtgggaaagggagaccctcctctcccaacacactcccccaatttgagtgggagaaatattcaatgaaatagatagcttaaagaaaaaacaatagaaaattcaggaaactttggacacacttttagaaatgtgaaatgctctggaaagtctcagcaatagaacaagtagaagaagga

SEQ ID NO: 454785 - DNA, 484 bp, Homo sapiens
gtctcgaactcctgacctcaagtaatcagcccacctcggcctccgaaagtgctgggattacaggcctgagccaccactcctgacctgtatagtattattctacacataaccgaatgctgaaatgatggaaagttaatcagaaaatgcttccataatctttgtattgaggtttaaaagacatcatacatatgccatgactgaagaggtaagtgggagaagaggagaaggcattttgatgtaatgggaaaactatgtacttttgacttagatctagttgattcacatttagcaatatcatgtaaccttgtggaagttacataaaccattcaacccatggctttcttatctgtaacatgaggctactacttctatttatcttgcagactagtgggaattagagtaagtggataagaaattcttatcactgaattagtttttgagtaaatggtaacttctcttattttttgagatggagtcttgctcc

SEQ ID NO: 454786 - DNA, 423 bp, Homo sapiens
tctgggtaattaaatgtttgtgtgtgtgtgtgtgtgtgtgtgtgtgtgtgtgtgtgtgtgtgtgtgtgtatttaggttttggtgaggtataaagccatttaagtctagctataccaaaaagaatttacctttccattacagatgattcattcagtaagcatttgttgaggatctttatatgccaggtgcttctctaggagctgaggataccaaaatggagaagacaagatttctgccctcaaggcgttcaacgtctggttgggagatggactcatgattgcagtattcatggtatcagtgacatgggtagtatcatctcaatgaaggaacaacttagggaaggaacgatgcacccgtctcttgccctgcctctccagtattcgggcttccttgctgggaaataactctattagcagagaagaa

SEQ ID NO: 454787 - DNA, 588 bp, Homo sapiens
ccccgcctccgcccccggctggcgtgagctgggtgtttcctgcctctctcagtccgggtttggagactcctgcgtcctccgacttttcatggaagagatgtcaggagaaagtgtggtgagctcagcggtgccagcggctgctacccgcaccacttccttcaagggcacgagccccagctccaaatacgtgaagctgaatgtgggtggagccctctactataccaccatgcagacgctgaccaagcaggacaccatgctgaaggccatgttcagcgggcgcatggaagtgctcaccgacagtgaaggctggatcctcattgaccgctgtgggaagcactttggtacgatactcaactaccttcgagacggggcggtgcctttacccgagagccgccgggagatcgaggagctgctagcagaagccaagtactacctagtccaaggcctggtggaagagtgccaggcggccctacaattcactggtggtgagaatccttctctcttcccagccatgactgccccatctcccctcgccagagcctgtccagccggtcaactttaaaaatgcagtgctaggcaggcctccta

SEQ ID NO: 454788 - DNA, 3558 bp, Homo sapiens
ccccgcctccgcccccggctggcgtgagctgggtgtttcctgcctctctcagtccgggtttggagactcctgcgtcctccgacttttcatggaagagatgtcaggagaaagtgtggtgagctcagcggtgccagcggctgctacccgcaccacttccttcaagggcacgagccccagctccaaatacgtgaagctgaatgtgggtggagccctctactataccaccatgcagacgctgaccaagcaggacaccatgctgaaggccatgttcagcgggcgcatggaagtgctcaccgacagtgaaggctggatcctcattgaccgctgtgggaagcactttggtacgatactcaactaccttcgagacggggcggtgcctttacccgagagccgccgggagatcgaggagctgctagcagaagccaagtactacctagtccaaggcctggtggaagagtgccaggcggccctacaaaacaaagatacttatgagcctttctgcaaggtccctgtgatcacctcatccaaggaagaacaaaaacttatagcgacttcaaataagccagccgtgaagttgctctacaacagaagtaacaacaaatactcatataccagcaattctgacgacaatatgttgaaaaacattgaactgtttgataagctgtctctgcgctttaacggaagggtcctgttcataaaggatgttattggggatgaaatctgctgctggtccttttatggtcagggccggaagattgctgaagtctgttgtacctccatcgtctatgccactgagaagaaacagaccaaggtggagtttcccgaagcccggatttatgaggagaccctgaacattttgctgtatgaggcccaggatggccggggacctgacaatgcgctcctggaggccacaggcggggcggcggggcgctcccaccacctggacgaggacgaggagcgggagcggatcgagcgcgtgcggaggatccacatcaagcgccctgatgaccgggcccacctccaccagtgagcaggcaagagaccgagccgccctcctctcaccgcccccactccctgccgtgctacacccagatcctgtgcaggctgccgggccccttctgcttcccttggagcctggagatacttttgtaacaagccagatgattattttggtattgcttgacaaggcaaattgattgtcttgacccaggcgtatgacccctgtcgttgaacaagctgtgtctaagatctctacttttcatgagaatctgagactctttggagccaggctttctcggttctcagaggaaaagtatgaatgagtgtgaagtgtatgtgagaacttttgtttgcaatatttatttttgtgggtgtcgacttcctatgtgggctttttgggtgacactcccttaagggttcagtttgacaattctgagagttgtcctgcagttggaggccaccagaggtatctgagctccctgcttcctatttcataatcctccagccccagcaggtccactcctggttcctgtgtgtttggcccgggcacaatccccactgctttgctagacgtgctttctgccatgtggctttgggcctagagcttgttgataattgcagcttgtggcagtggaaatatggctgaatgagcgtctaaatcgttgagaccagtgcaactttgggtgcaaggctttgtttagggatcaagccttttgccaccttgggctggtctttggcctggtgctcactgggaccccatatgtctgcgtaggagcagaactttccatggcagtaagtgtccagctctgtttctggttctttccccaactccagccccgtccagttgttctcctgattgacccgactccactccaggaaggccatctgaccctgtgacaggcatagctcataaactacccctcccaggctcctctgcacctgcaaaggaacaggagtgagtcgtgactgacaggggtggttgagactagactaggtagagtagttaccaggagatgtgaatgtgcgtcaggtgatggatgggtttgtcaagggaatcgttaccgttttataccaaaggtattaacatgggcagcctttgacacatgtattccaaaaacgagtttatattttcaaacggtttttacagcttagactttgtacttactgccctgcctgtgacagttgtatgccttcattttgtatccaacagcaaagtctacaataaaactttaaaacaatcatgactgaatgtcaaaatcgtgtattgggcagatgctttttaaactgtcgtgtgagaaacttttatattaggccatttggattttattaagtgctaaggaaagagggcttacaaaatgtttcgtaaatattttatactgtttaagtgttaaacaccaaccctgtctttcttttgggttgagcttttttagaaagtcgaagtgaatgttggccaggaaaatggaaaagccattgtataaatttttttttgaggcggagtcttgctctattggccaggctggagtgtagtggcaccatctccacttaccacaacttgtgcctcctgggttcaagcgattctgctgcctcagcctcccgagtagctgggattgcaggtacccatcagcccatgcccagctaattttgtatttttagtagagatggggtttcaccatgttggccaggctggtcttgaactcctgaccctgtgatccgaccaccttggcctcccaaagtgctgggattacaggtgtgagtcaccacacctggctgcatagtgttttaaatgtttgtgtgaagaatgagtttgtggaacaatttgatttgctgtggcctctatgcctaatgagctagtgtttctggcagctctctctacccaactttgcacttgtagttttgagtctttgtctctctggaatatgaacaggtttataaaacattccatggtgaacaattctgtcggctgcattatagccatgagtgaatagacagcattggctggtccaagctctgttattgagtatacaaggaactgatttttcttatgttagcactaagggcaaaaaccaatatttataatgtaagcactatccaggtaaaacactggcccaagatttggtaaagagatttcattgcaatgtaataactacagttttttacaaattggaacagctttggtgtgtcgtaatcaagggttttttttgtttgtttgtttcaaataagccatctgattgtggtgactggggcccatgtccaagacaattcctggcatattctgtcaccctcccgtggggcgatcactgtgtggggaccccattccccagttaaagtgtgtctctgtaccttacaacagcgattcaggacccaagtgtgaacaacactcagcccgccctctggagcgtgtgctgtctttagggccctacccaaagtcactgtaacagttaagtgtgtcattaacctttctgtctctttgcgccataaaaaaatgctcaaagttttagatgtagccactgtatgttgtacaaacgttggcgacatgtaaaataaaagtcataaaatgct

SEQ ID NO: 454789 - DNA, 1897 bp, Homo sapiens
ccaatatgtgcctcttctatatctacccccttgtctttgcctctgatttttacacagtgtagagtggccagcagtgaacaggttgaggatgtgcgggtagatagataactttgggtctggtttgtgtctgtgttcatgtttgtttaagggatatgtgtgactgtgggtggggacgtgtgcttgtggggcacaggtggcccctgctggagcccggctgggcgcagcgcctatgtaggacgggtgttctcagtgacctacctcccaggctcctctgcacctgcaaaggaacaggagtgagtcgtgactgacaggggtggttgagactagactaggtagagtagttaccaggagatgtgaatgtgcgtcaggtgatggatgggtttgtcaagggaatcgttaccgttttataccaaaggtattaacatgggcagcctttgacacatgtattccaaaaacgagtttatattttcaaacggtttttacagcttagactttgtacttactgccctgcctgtgacagttgtatgccttcattttgtatccaacagcaaagtctacaataaaactttaaaacaatcatgactgaatgtcaaaatcgtgtattgggcagatgctttttaaactgtcgtgtgagaaacttttatattaggccatttggattttattaagtgctaaggaaagagggcttacaaaatgtttcgtaaatattttatactgtttaagtgttaaacaccaaccctgtctttcttttgggttgagcttttttagaaagtcgaagtgaatgttggccaggaaaatggaaaagccattgtataaatttttttttgaggcggagtcttgctctattggccaggctggagtgtagtggcaccatctccacttaccacaacttgtgcctcctgggttcaagcgattctgctgcctcagcctcccgagtagctgggattgcaggtacccatcagcccatgcccagctaattttgtatttttagtagagatggggtttcaccatgttggccaggctggtcttgaactcctgaccctgtgatccgaccaccttggcctcccaaagtgctgggattacaggtgtgagtcaccacacctggctgcatagtgttttaaatgtttgtgtgaagaatgagtttgtggaacaatttgatttgctgtggcctctatgcctaatgagctagtgtttctggcagctctctctacccaactttgcacttgtagttttgagtctttgtctctctggaatatgaacaggtttataaaacattccatggtgaacaattctgtcggctgcattatagccatgagtgaatagacagcattggctggtccaagctctgttattgagtatacaaggaactgatttttcttatgttagcactaagggcaaaaaccaatatttataatgtaagcactatccaggtaaaacactggcccaagatttggtaaagagatttcattgcaatgtaataactacagttttttacaaattggaacagctttggtgtgtcgtaatcaagggttttttttgtttgtttgtttcaaataagccatctgattgtggtgactggggcccatgtccaagacaattcctggcatattctgtcaccctcccgtggggcgatcactgtgtggggaccccattccccagttaaagtgtgtctctgtaccttacaacagcgattcaggacccaagtgtgaacaacactcagcccgccctctggagcgtgtgctgtctttagggccctacccaaagtcactgtaacagttaagtgtgtcattaacctttctgtctctttgcgccataaaaaaatgctcaaagttttagatgtagccactgtatgttgtacaaacgttggcgacatgtaaaataaaagtcataaaatgct

SEQ ID NO: 454790 - DNA, 2633 bp, Homo sapiens
ccccgcctccgcccccggctggcgtgagctgggtgtttcctgcctctctcagtccgggtttggagactcctgcgtcctccgacttttcatggaagagatgtcaggagaaagtgtggtgagctcagcggtgccagcggctgctacccgcaccacttccttcaagggcacgagccccagctccaaatacgtgaagctgaatgtgggtggagccctctactataccaccatgcagacgctgaccaagcaggacaccatgctgaaggccatgttcagcgggcgcatggaagtgctcaccgacagtgaaggctggatcctcattgaccgctgtgggaagcactttggtacgatactcaactaccttcgagacggggcggtgcctttacccgagagccgccgggagatcgaggagctgctagcagaagccaagtactacctagtccaaggcctggtggaagagtgccaggcggccctacaaaacaaagatacttatgagcctttctgcaaggtccctgtgatcacctcatccaaggaagaacaaaaacttatagcgacttcaaataagccagccgtgaagttgctctacaacagaagtaacaacaaatactcatataccagcaattctgacgacaatatgttgaaaaacattgaactgtttgataagctgtctctgcgctttaacggaagggtcctgttcataaaggatgttattggggatgaaatctgctgctggtccttttatggtcagggccggaagattgctgaagtctgttgtacctccatcgtctatgccactgagaagaaacagaccaaggtggagtttcccgaagcccggatttatgaggagaccctgaacattttgctgtatgaggcccaggatggccggggacctgacaatgcgctcctggaggccacaggcggggcggcggggcgctcccaccacctggacgaggacgaggagcgggagcggatcgagcgcgtgcggaggatccacatcaagcgccctgatgaccgggcccacctccaccagtgagcaggcaagagaccgagccgccctcctctcaccgcccccactccctgccgtgctacacccagatcctgtgcaggctgccgggccccttctgcttcccttggagcctggagatacttttgtaacaagccagatgattattttggtattgcttgacaaggcaaattgattgtcttgacccaggcgtatgacccctgtcgttgaacaagctgtgtctaagatctctacttttcatgagaatctgagactctttggagccaggctttctcggttctcagaggaaaagtatgaatgagtgtgaagtgtatgtgagaacttttgtttgcaatatttatttttgtgggtgtcgacttcctatgtgggctttttgggtgacactcccttaagggttcagtttgacaattctgagagttgtcctgcagttggaggccaccagaggtatctgagctccctgcttcctatttcataatcctccagccccagcaggtccactcctggttcctgtgtgtttggcccgggcacaatccccactgctttgctagacgtgctttctgccatgtggctttgggcctagagcttgttgataattgcagcttgtggcagtggaaatatggctgaatgagcgtctaaatcgttgagaccagtgcaactttgggtgcaaggctttgtttagggatcaagccttttgccaccttgggctggtctttggcctggtgctcactgggaccccatatgtctgcgtaggagcagaactttccatggcagtaagtgtccagctctgtttctggttctttccccaactccagccccgtccagttgttctcctgattgacccgactccactccaggaaggccatctgaccctgtgacaggcatagctcataaactacccctccctgggatcccgctcctcttcagcctccttccccatgaagctgggctaactttctaagtcattttgcttagaaattcagtgtggcccataccctttgtcctcccagcctggcatccaggcagggacaccctcacaccaccagccccagggagcttccctgctataaacacagacccccttgtctttgcctctgatttttacacagtgtagagtggccagcagtgaacaggttgaggatgtgcgggtagatagataactttgggtctggtttgtgtctgtgttcatgtttgtttaagggatatgtgtgactgtgggtggggacgtgtgcttgtggggcacaggtggcccctgctggagcccggctgggcgcagcgcctatgtaggacgggtgttctcagtgacctacctcccaggctcctctgcacctgcaaaggaacaggagtgagtcgtgactgacaggggtggttgagactagactaggtagagtagttaccaggagatgtgaatgtgcgtcaggtgatggatgggtttgtcaagggaatcgttaccgttttataccaaaggtattaacatgggcagcctttgacacatgtattccaaaaacgagctctccacctccgcccggaaagttggtggaacgggtggtgccaaacagtttgcccctttcgcatgtggccctataaatagaatccgccctttctgtcttcctta

SEQ ID NO: 454791 - DNA, 2651 bp, Homo sapiens
ccccgcctccgcccccggctggcgtgagctgggtgtttcctgcctctctcagtccgggtttggagactcctgcgtcctccgacttttcatggaagagatgtcaggagaaagtgtggtgagctcagcggtgccagcggctgctacccgcaccacttccttcaagggcacgagccccagctccaaatacgtgaagctgaatgtgggtggagccctctactataccaccatgcagacgctgaccaagcaggacaccatgctgaaggccatgttcagcgggcgcatggaagtgctcaccgacagtgaaggctggatcctcattgaccgctgtgggaagcactttggtacgatactcaactaccttcgagacggggcggtgcctttacccgagagccgccgggagatcgaggagctgctagcagaagccaagtactacctagtccaaggcctggtggaagagtgccaggcggccctacaaaacaaagatacttatgagcctttctgcaaggtccctgtgatcacctcatccaaggaagaacaaaaacttatagcgacttcaaataagccagccgtgaagttgctctacaacagaagtaacaacaaatactcatataccagcaattctgacgacaatatgttgaaaaacattgaactgtttgataagctgtctctgcgctttaacggaagggtcctgttcataaaggatgttattggggatgaaatctgctgctggtccttttatggtcagggccggaagattgctgaagtctgttgtacctccatcgtctatgccactgagaagaaacagaccaaggtggagtttcccgaagcccggatttatgaggagaccctgaacattttgctgtatgaggcccaggatggccggggacctgacaatgcgctcctggaggccacaggcggggcggcggggcgctcccaccacctggacgaggacgaggagcgggagcggatcgagcgcgtgcggaggatccacatcaagcgccctgatgaccgggcccacctccaccagtgagcaggcaagagaccgagccgccctcctctcaccgcccccactccctgccgtgctacacccagatcctgtgcaggctgccgggccccttctgcttcccttggagcctggagatacttttgtaacaagccagatgattattttggtattgcttgacaaggcaaattgattgtcttgacccaggcgtatgacccctgtcgttgaacaagctgtgtctaagatctctacttttcatgagaatctgagactctttggagccaggctttctcggttctcagaggaaaagtatgaatgagtgtgaagtgtatgtgagaacttttgtttgcaatatttatttttgtgggtgtcgacttcctatgtgggctttttgggtgacactcccttaagggttcagtttgacaattctgagagttgtcctgcagttggaggccaccagaggtatctgagctccctgcttcctatttcataatcctccagccccagcaggtccactcctggttcctgtgtgtttggcccgggcacaatccccactgctttgctagacgtgctttctgccatgtggctttgggcctagagcttgttgataattgcagcttgtggcagtggaaatatggctgaatgagcgtctaaatcgttgagaccagtgcaactttgggtgcaaggctttgtttagggatcaagccttttgccaccttgggctggtctttggcctggtgctcactgggaccccatatgtctgcgtaggagcagaactttccatggcagtaagtgtccagctctgtttctggttctttccccaactccagccccgtccagttgttctcctgattgacccgactccactccaggaaggccatctgaccctgtgacaggcatagctcataaactacccctccctgggatcccgctcctcttcagcctccttccccatgaagctgggctaactttctaagtcattttgcttagaaattcagtgtggcccataccctttgtcctcccagcctggcatccaggcagggacaccctcacaccaccagccccagggagcttccctgctataaacacagacccccttgtctttgcctctgatttttacacagtgtagagtggccagcagtgaacaggttgaggatgtgcgggtagatagataactttgggtctggtttgtgtctgtgttcatgtttgtttaagggatatgtgtgactgtgggtggggacgtgtgcttgtggggcacaggtggcccctgctggagcccggctgggcgcagcgcctatgtaggacgggtgttctcagtgacctacctcccaggctcctctgcacctgcaaaggaacaggagtgagtcgtgactgacaggggtggttgagactagactaggtagagtagttaccaggagatgtgaatgtgcgtcaggtgatggatgggtttgtcaagggaatcgttaccgttttataccaaaggtattaacatgggcagcctttgacacatgtattccaaaaacgagtttatattttcaaacggtttttacagcttagactttgtacttactgccctgcctgtgacagttgtatgccttcattttgtatccaacagcaaagtctacaataaaactttaaaacaatcatg

SEQ ID NO: 454792 - DNA, 3967 bp, Homo sapiens
ccccgcctccgcccccggctggcgtgagctgggtgtttcctgcctctctcagtccgggtttggagactcctgcgtcctccgacttttcatggaagagatgtcaggagaaagtgtggtgagctcagcggtgccagcggctgctacccgcaccacttccttcaagggcacgagccccagctccaaatacgtgaagctgaatgtgggtggagccctctactataccaccatgcagacgctgaccaagcaggacaccatgctgaaggccatgttcagcgggcgcatggaagtgctcaccgacagtgaaggctggatcctcattgaccgctgtgggaagcactttggtacgatactcaactaccttcgagacggggcggtgcctttacccgagagccgccgggagatcgaggagctgctagcagaagccaagtactacctagtccaaggcctggtggaagagtgccaggcggccctacaaaacaaagatacttatgagcctttctgcaaggtccctgtgatcacctcatccaaggaagaacaaaaacttatagcgacttcaaataagccagccgtgaagttgctctacaacagaagtaacaacaaatactcatataccagcaattctgacgacaatatgttgaaaaacattgaactgtttgataagctgtctctgcgctttaacggaagggtcctgttcataaaggatgttattggggatgaaatctgctgctggtccttttatggtcagggccggaagattgctgaagtctgttgtacctccatcgtctatgccactgagaagaaacagaccaaggtggagtttcccgaagcccggatttatgaggagaccctgaacattttgctgtatgaggcccaggatggccggggacctgacaatgcgctcctggaggccacaggcggggcggcggggcgctcccaccacctggacgaggacgaggagcgggagcggatcgagcgcgtgcggaggatccacatcaagcgccctgatgaccgggcccacctccaccagtgagcaggcaagagaccgagccgccctcctctcaccgcccccactccctgccgtgctacacccagatcctgtgcaggctgccgggccccttctgcttcccttggagcctggagatacttttgtaacaagccagatgattattttggtattgcttgacaaggcaaattgattgtcttgacccaggcgtatgacccctgtcgttgaacaagctgtgtctaagatctctacttttcatgagaatctgagactctttggagccaggctttctcggttctcagaggaaaagtatgaatgagtgtgaagtgtatgtgagaacttttgtttgcaatatttatttttgtgggtgtcgacttcctatgtgggctttttgggtgacactcccttaagggttcagtttgacaattctgagagttgtcctgcagttggaggccaccagaggtatctgagctccctgcttcctatttcataatcctccagccccagcaggtccactcctggttcctgtgtgtttggcccgggcacaatccccactgctttgctagacgtgctttctgccatgtggctttgggcctagagcttgttgataattgcagcttgtggcagtggaaatatggctgaatgagcgtctaaatcgttgagaccagtgcaactttgggtgcaaggctttgtttagggatcaagccttttgccaccttgggctggtctttggcctggtgctcactgggaccccatatgtctgcgtaggagcagaactttccatggcagtaagtgtccagctctgtttctggttctttccccaactccagccccgtccagttgttctcctgattgacccgactccactccaggaaggccatctgaccctgtgacaggcatagctcataaactacccctccctgggatcccgctcctcttcagcctccttccccatgaagctgggctaactttctaagtcattttgcttagaaattcagtgtggcccataccctttgtcctcccagcctggcatccaggcagggacaccctcacaccaccagccccagggagcttccctgctataaacacagacccccttgtctttgcctctgatttttacacagtgtagagtggccagcagtgaacaggttgaggatgtgcgggtagatagataactttgggtctggtttgtgtctgtgttcatgtttgtttaagggatatgtgtgactgtgggtggggacgtgtgcttgtggggcacaggtggcccctgctggagcccggctgggcgcagcgcctatgtaggacgggtgttctcagtgacctacctcccaggctcctctgcacctgcaaaggaacaggagtgagtcgtgactgacaggggtggttgagactagactaggtagagtagttaccaggagatgtgaatgtgcgtcaggtgatggatgggtttgtcaagggaatcgttaccgttttataccaaaggtattaacatgggcagcctttgacacatgtattccaaaaacgagtttatattttcaaacggtttttacagcttagactttgtacttactgccctgcctgtgacagttgtatgccttcattttgtatccaacagcaaagtctacaataaaactttaaaacaatcatgactgaatgtcaaaatcgtgtattgggcagatgctttttaaactgtcgtgtgagaaacttttatattaggccatttggattttattaagtgctaaggaaagagggcttacaaaatgtttcgtaaatattttatactgtttaagtgttaaacaccaaccctgtctttcttttgggttgagcttttttagaaagtcgaagtgaatgttggccaggaaaatggaaaagccattgtataaatttttttttgaggcggagtcttgctctattggccaggctggagtgtagtggcaccatctccacttaccacaacttgtgcctcctgggttcaagcgattctgctgcctcagcctcccgagtagctgggattgcaggtacccatcagcccatgcccagctaattttgtatttttagtagagatggggtttcaccatgttggccaggctggtcttgaactcctgaccctgtgatccgaccaccttggcctcccaaagtgctgggattacaggtgtgagtcaccacacctggctgcatagtgttttaaatgtttgtgtgaagaatgagtttgtggaacaatttgatttgctgtggcctctatgcctaatgagctagtgtttctggcagctctctctacccaactttgcacttgtagttttgagtctttgtctctctggaatatgaacaggtttataaaacattccatggtgaacaattctgtcggctgcattatagccatgagtgaatagacagcattggctggtccaagctctgttattgagtatacaaggaactgatttttcttatgttagcactaagggcaaaaaccaatatttataatgtaagcactatccaggtaaaacactggcccaagatttggtaaagagatttcattgcaatgtaataactacagttttttacaaattggaacagctttggtgtgtcgtaatcaagggttttttttgtttgtttgtttcaaataagccatctgattgtggtgactggggcccatgtccaagacaattcctggcatattctgtcaccctcccgtggggcgatcactgtgtggggaccccattccccagttaaagtgtgtctctgtaccttacaacagcgattcaggacccaagtgtgaacaacactcagcccgccctctggagcgtgtgctgtctttagggccctacccaaagtcactgtaacagttaagtgtgtcattaacctttctgtctctttgcgccataaaaaaatgctcaaagttttagatgtagccactgtatgttgtacaaacgttggcgacatgtaaaataaaagtcataaaatgct

SEQ ID NO: 454793 - DNA, 4500 bp, Homo sapiens
ccccgcctccgcccccggctggcgtgagctgggtgtttcctgcctctctcagtccgggtttggagactcctgcgtcctccgacttttcatggaagagatgtcaggagaaagtgtggtgagctcagcggtgccagcggctgctacccgcaccacttccttcaagggcacgagccccagctccaaatacgtgaagctgaatgtgggtggagccctctactataccaccatgcagacgctgaccaagcaggacaccatgctgaaggccatgttcagcgggcgcatggaagtgctcaccgacagtgaaggctggatcctcattgaccgctgtgggaagcactttggtacgatactcaactaccttcgagacggggcggtgcctttacccgagagccgccgggagatcgaggagctgctagcagaagccaagtactacctagtccaaggcctggtggaagagtgccaggcggccctacaaaacaaagatacttatgagcctttctgcaaggtccctgtgatcacctcatccaaggaagaacaaaaacttatagcgacttcaaataagccagccgtgaagttgctctacaacagaagtaacaacaaatactcatataccagcaattctgacgacaatatgttgaaaaacattgaactgtttgataagctgtctctgcgctttaacggaagggtcctgttcataaaggatgttattggggatgaaatctgctgctggtccttttatggtcagggccggaagattgctgaagtctgttgtacctccatcgtctatgccactgagaagaaacagaccaaggtggagtttcccgaagcccggatttatgaggagaccctgaacattttgctgtatgaggcccaggatggccggggacctgacaatgcgctcctggaggccacaggcggggcggcggggcgctcccaccacctggacgaggacgaggagcgggagcggatcgagcgcgtgcggaggatccacatcaagcgccctgatgaccgggcccacctccaccagtgagcaggcaagagaccgagccgccctcctctcaccgcccccactccctgccgtgctacacccagatcctgtgcaggctgccgggccccttctgcttcccttggagcctggagatacttttgtaacaagccagatgattattttggtattgcttgacaaggcaaattgattgtcttgacccaggcgtatgacccctgtcgttgaacaagctgtgtctaagatctctacttttcatgagaatctgagactctttggagccaggctttctcggttctcagaggaaaagtatgaatgagtgtgaagtgtatgtgagaacttttgtttgcaatatttatttttgtgggtgtcgacttcctatgtgggctttttgggtgacactcccttaagggttcagtttgacaattctgagagttgtcctgcagttggaggccaccagaggtatctgagctccctgcttcctatttcataatcctccagccccagcaggtccactcctggttcctgtgtgtttggcccgggcacaatccccactgctttgctagacgtgctttctgccatgtggctttgggcctagagcttgttgataattgcagcttgtggcagtggaaatatggctgaatgagcgtctaaatcgttgagaccagtgcaactttgggtgcaaggctttgtttagggatcaagccttttgccaccttgggctggtctttggcctggtgctcactgggaccccatatgtctgcgtaggagcagaactttccatggcagtaagtgtccagctctgtttctggttctttccccaactccagccccgtccagttgttctcctgattgacccgactccactccaggaaggccatctgaccctgtgacaggcatagctcataaactacccctccctgggatcccgctcctcttcagcctccttccccatgaagctgggctaactttctaagtcattttgcttagaaattcagtgtggcccataccctttgtcctcccagcctggcatccaggcagggacaccctcacaccaccagccccagggagcttccctgctataaacacagacccccttgtctttgcctctgatttttacacagtgtagagtggccagcagtgaacaggttgaggatgtgcgggtagatagataactttgggtctggtttgtgtctgtgttcatgtttgtttaagggatatgtgtgactgtgggtggggacgtgtgcttgtggggcacaggtggcccctgctggagcccggctgggcgcagcgcctatgtaggacgggtgttctcagtgacctacctcccaggctcctctgcacctgcaaaggaacaggagtgagtcgtgactgacaggggtggttgagactagactaggtagagtagttaccaggagatgtgaatgtgcgtcaggtgatggatgggtttgtcaagggaatcgttaccgttttataccaaaggtattaacatgggcagcctttgacacatgtattccaaaaacgagtttatattttcaaacggtttttacagcttagactttgtacttactgccctgcctgtgacagttgtatgccttcattttgtatccaacagcaaagtctacaataaaactttaaaacaatcatgactgaatgtcaaaatcgtgtattgggcagatgctttttaaactgtcgtgtgagaaacttttatattaggccatttggattttattaagtgctaaggaaagagggcttacaaaatgtttcgtaaatattttatactgtttaagtgttaaacaccaaccctgtctttcttttgggttgagcttttttagaaagtcgaagtgaatgttggccaggaaaatggaaaagccattgtataaatttttttttgaggcggagtcttgctctattggccaggctggagtgtagtggcaccatctccacttaccacaacttgtgcctcctgggttcaagcgattctgctgcctcagcctcccgagtagctgggattgcaggtacccatcagcccatgcccagctaattttgtatttttagtagagatggggtttcaccatgttggccaggctggtcttgaactcctgaccctgtgatccgaccaccttggcctcccaaagtgctgggattacaggtgtgagtcaccacacctggctgcatagtgttttaaatgtttgtgtgaagaatgagtttgtggaacaatttgatttgctgtggcctctatgcctaatgagctagtgtttctggcagctctctctacccaactttgcacttgtagttttgagtctttgtctctctggaatatgaacaggtttataaaacattccatggtgaacaattctgtcggctgcattatagccatgagtgaatagacagcattggctggtccaagctctgttattgagtatacaaggaactgatttttcttatgttagcactaagggcaaaaaccaatatttataatgtaagcactatccaggtaaaacactggcccaagatttggtaaagagatttcattgcaatgtaataactacagttttttacaaattggaacagctttggtgtgtcgtaatcaagggttttttttgtttgtttgtttcaaataagccatctgattgtggtgactggggcccatgtccaagacaattcctggcatattctgtcaccctcccgtggggcgatcactgtgtggggaccccattccccagttaaagtgtgtctctgtaccttacaacagcgattcaggacccaagtgtgaacaacactcagcccgccctctggagcgtgtgctgtctttagggccctacccaaagtcactgtaacagttaagtgtgtcattaacctttctgtctctttgcgccataaaaaaatgctcaaagttttagatgtagccactgtatgttgtacaaacgttggcgacatgtaaaataaaagtcataaaatgctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccgggcaaaaactaacaccatgcaggggggcggccaccaatcacgctgcacacagcagacgtcgtaggcgtagcacaaggaggggaccccaacataaagagggagagtggtacagaggcaccctcggacgacgcgcagccagtaagtatgaacacgtgacaagacgggaggaacgacaagtgcacaccaccggagagcatccatcgcccgcggagacagaagacccccaccagcaggcgggggggagcggaccacaagcgggggcggaaccgcagccaccacaccgcgcagaacaagaaagccgacccccggaaggagagaacacgacgaaccaacaggcgggaataagaagaacgtagacaaacacggacgactgtacggccaaacggaaagaaagagcgccccggacgccgacgagaacagaaataagcgg

SEQ ID NO: 454794 - DNA, 3831 bp, Homo sapiens
ctttcccgagtccgtttgaggaagtccccgaggcgcacagagcaagcccacgcgagggcacctctggaggggagcgcctgcaggaccttgtaaagtcaaaaatgtcagaaacttccaggaccgcctttggaggcagaagagcagttccacccaataactctaatgcagcggaagatgacctgcccacagtggagcttcagggcgtggtgccccggggcgtcaacctgcaagagtttcttaatgtcacgagcgttcacctgttcaaggagagatgggacactaacaaggtggaccaccacactgacaagtatgaaaacaacaagctgattgtccgcagagggcagtctttctatgtgcagattgacttcagtcgtccatatgaccccagaagggatctcttcagggtggaatacgtcattggtcgctacccacaggagaacaagggaacctacatcccagtgcctatagtctcagagttacaaagtggaaagtggggggccaagattgtcatgagagaggacaggtctgtgcggctgtccatccagtcttcccccaaatgtattgtggggaaattccgcatgtatgttgctgtctggactccctatggcgtacttcgaaccagtcgaaacccagaaacagacacgtacattctcttcaatccttggtgtgaagatgatgctgtgtatctggacaatgagaaagaaagagaagagtatgtcctgaatgacatcggggtaattttttatggagaggtcaatgacatcaagaccagaagctggagctatggtcagtttgaagatggcatcctggacacttgcctgtatgtgatggacagagcacaaatggacctctctggaagagggaatcccatcaaagtcagccgtgtggggtctgcaatggtgaatgccaaagatgacgaaggtgtcctcgttggatcctgggacaatatctatgcctatggcgtccccccatcggcctggactggaagcgttgacattctattggaataccggagctctgagaatccagtccggtatggccaatgctgggtttttgctggtgtctttaacacatttttacgatgccttggaataccagcaagaattgttaccaattatttctctgcccatgataatgatgccaatttgcaaatggacatcttcctggaagaagatgggaacgtgaattccaaactcaccaaggattcagtgtggaactaccactgctggaatgaagcatggatgacaaggcctgaccttcctgttggatttggaggctggcaagctgtggacagcaccccccaggaaaatagcgatggcatgtatcggtgtggccccgcctcggttcaagccatcaagcacggccatgtctgcttccaatttgatgcaccttttgtttttgcagaggtcaacagcgacctcatttacattacagctaagaaagatggcactcatgtggtggaaaatgtggatgccacccacattgggaaattaattgtgaccaaacaaattggaggagatggcatgatggatattactgatacttacaaattccaagaaggtcaagaagaagagagattggccctagaaactgccctgatgtacggagctaaaaagcccctcaacacagaaggtgtcatgaaatcaaggtccaacgttgacatggactttgaagtggaaaatgctgtgctgggaaaagacttcaagctctccatcaccttccggaacaacagccacaaccgttacaccatcacagcttatctctcagccaacatcaccttctacaccggggtcccgaaggcagaattcaagaaggagacgttcgacgtgacgctggagcccttgtccttcaagaaagaggcggtgctgatccaagccggcgagtacatgggtcagctgctggaacaagcgtccctgcacttctttgtcacagctcgcatcaatgagaccagggatgttctggccaagcaaaagtccaccgtgctaaccatccctgagatcatcatcaaggtccgtggcactcaggtagttggttctgacatgactgtgacagttgagtttaccaatcctttaaaagaaaccctgcgaaatgtctgggtacacctggatggtcctggagtaacaagaccaatgaagaagatgttccgtgaaatccggcccaactccaccgtgcagtgggaagaagtgtgccggccctgggtctctgggcatcggaagctgatagccagcatgagcagtgactccctgagacatgtgtatggcgagctggacgtgcagattcaaagacgaccttccatgtgaatgcacaggaagctgagatgaaccctggcatttggcctcttgtagtcttggctaaggaaattctaacgcaaaaatagctcttgctttgacttaggtgtgaagacccagacaggactgcagagggccccagagtggagatcccacatatttcaaaaacatgcttttccaaacccaggctattcggcaaggaagttagtttttaatctctccaccttccaaagagtgctaagcattagctttaattaagctctcatagctcataagagtaacagtcatcatttatcatcacaaatggctacatctccaaatatcagtgggctctcttaccagggagatttgctcaatacctggcctcatttaaaacaagacttcagattccccactcagccttttgggaataatagcacatgatttgggctctagaattccagtcccctttctcggggtcaggttctaccctccatgtgagaatatttttcccaggactagagcacaacataatttttatttttggcaaagccagaaaaagatctttcattttgcacctgcagccaagcaaatgcctgccaaattttagatttaccttgttagaagaggtggccccatattaacaaattgcatttgtgggaaacttaaccacctacaaggagataagaaagcaggtgcaacactcaagtctattgaataatgtagttttgtgatgcattttatagaatgtgtcacactgtggcctgatcagcaggagccaatatcccttactttaaccctttctgggatgcaatactaggaagtaaagtgaagaatttatctctttagttagtgattatatttcacccatctctcaggaatcatctcctttgcagaatgatgcaggttcaggtcccctttcagagatataataagcccaacaagttgaagaagctggcggatctagtgaccagatatatagaaggactgcagccactgattctctcttgtccttcacatcacccatgttgagacctcagcttggcactcaggtgctgaagggtaatatggactcagccttgcaaatagccagtgctagttctgacccaaccacagaggatgctgacatcatttgtattatgttccaaggctactacagagaaggctgcctgctatgtatttgcaaggctgatttatggtcagaatttccctctgatatgtctagggtgtgatttaggtcagtagactgtgattcttagcaaaaaatgaacagtgataagtatactgggggcaaaatcagaatggaatgctctggtctatataaccacatttctaagcctttgagactgttcctgagccttcagcactaacctatgagggtgagctggtcccctctatatatacatcatacttaactttactaagtaatctcacagcatttgccaagtctcccaatatccaattttaaaatgaaatgcattttgctagacagttaaactggcttaacttagtatattattattaattacaatgtaatagaagcttaaaataaagttaaactgat

SEQ ID NO: 454795 - DNA, 3969 bp, Homo sapiens
ctttcccgagtccgtttgaggaagtccccgaggcgcacagagcaagcccacgcgagggcacctctggaggggagcgcctgcaggaccttgtaaagtcaaaaatgtcagaaacttccaggaccgcctttggaggcagaagagcagttccacccaataactctaatgcagcggaagatgacctgcccacagtggagcttcagggcgtggtgccccggggcgtcaacctgcaagagtttcttaatgtcacgagcgttcacctgttcaaggagagatgggacactaacaaggtggaccaccacactgacaagtatgaaaacaacaagctgattgtccgcagagggcagtctttctatgtgcagattgacttcagtcgtccatatgaccccagaagggatctcttcagggtggaatacgtcattggtcgctacccacaggagaacaagggaacctacatcccagtgcctatagtctcagagttacaaagtggaaagtggggggccaagattgtcatgagagaggacaggtctgtgcggctgtccatccagtcttcccccaaatgtattgtggggaaattccgcatgtatgttgctgtctggactccctatggcgtacttcgaaccagtcgaaacccagaaacagacacgtacattctcttcaatccttggtgtgaagatgatgctgtgtatctggacaatgagaaagaaagagaagagtatgtcctgaatgacatcggggtaattttttatggagaggtcaatgacatcaagaccagaagctggagctatggtcagtttgaagatggcatcctggacacttgcctgtatgtgatggacagagcacaaatggacctctctggaagagggaatcccatcaaagtcagccgtgtggggtctgcaatggtgaatgccaaagatgacgaaggtgtcctcgttggatcctgggacaatatctatgcctatggcgtccccccatcggcctggactggaagcgttgacattctattggaataccggagctctgagaatccagtccggtatggccaatgctgggtttttgctggtgtctttaacacatttttacgatgccttggaataccagcaagaattgttaccaattatttctctgcccatgataatgatgccaatttgcaaatggacatcttcctggaagaagatgggaacgtgaattccaaactcaccaaggattcagtgtggaactaccactgctggaatgaagcatggatgacaaggcctgaccttcctgttggatttggaggctggcaagctgtggacagcaccccccaggaaaatagcgatggcatgtatcggtgtggccccgcctcggttcaagccatcaagcacggccatgtctgcttccaatttgatgcaccttttgtttttgcagaggtcaacagcgacctcatttacattacagctaagaaagatggcactcatgtggtggaaaatgtggatgccacccacattgggaaattaattgtgaccaaacaaattggaggagatggcatgatggatattactgatacttacaaattccaagaaggtcaagaagaagagagattggccctagaaactgccctgatgtacggagctaaaaagcccctcaacacagaaggtgtcatgaaatcaaggtccaacgttgacatggactttgaagtggaaaatgctgtgctgggaaaagacttcaagctctccatcaccttccggaacaacagccacaaccgttacaccatcacagcttatctctcagccaacatcaccttctacaccggggtcccgaaggcagaattcaagaaggagacgttcgacgtgacgctggagcccttgtccttcaagaaagaggcggtgctgatccaagccggcgagtacatgggtcagctgctggaacaagcgtccctgcacttctttgtcacagctcgcatcaatgagaccagggatgttctggccaagcaaaagtccaccgtgctaaccatccctgagatcatcatcaaggtccgtggcactcaggtagttggttctgacatgactgtgacagttgagtttaccaatcctttaaaagaaaccctgcgaaatgtctgggtacacctggatggtcctggagtaacaagaccaatgaagaagatgttccgtgaaatccggcccaactccaccgtgcagtgggaagaagtgtgccggccctgggtctctgggcatcggaagctgatagccagcatgagcagtgactccctgagacatgtgtatggcgagctggacgtgcagattcaaagacgaccttccatgtgaatgcacaggaagctgagatgaaccctggcatttggcctcttgtagtcttggctaaggaaattctaacgcaaaaatagctcttgctttgacttaggtgtgaagacccagacaggactgcagagggccccagagtggagatcccacatatttcaaaaacatgcttttccaaacccaggctattcggcaaggaagttagtttttaatctctccaccttccaaagagtgctaagcattagctttaattaagctctcatagctcataagagtaacagtcatcatttatcatcacaaatggctacatctccaaatatcagtgggctctcttaccagggagatttgctcaatacctggcctcatttaaaacaagacttcagattccccactcagccttttgggaataatagcacatgatttgggctctagaattccagtcccctttctcggggtcaggttctaccctccatgtgagaatatttttcccaggactagagcacaacataatttttatttttggcaaagccagaaaaagatctttcattttgcacctgcagccaagcaaatgcctgccaaattttagatttaccttgttagaagaggtggccccatattaacaaattgcatttgtgggaaacttaaccacctacaaggagataagaaagcaggtgcaacactcaagtctattgaataatgtagttttgtgatgcattttatagaatgtgtcacactgtggcctgatcagcaggagccaatatcccttactttaaccctttctgggatgcaatactaggaagtaaagtgaagaatttatctctttagttagtgattatatttcacccatctctcaggaatcatctcctttgcagaatgatgcaggttcaggtcccctttcagagatataataagcccaacaagttgaagaagctggcggatctagtgaccagatatatagaaggactgcagccactgattctctcttgtccttcacatcacccatgttgagacctcagcttggcactcaggtgctgaagggtaatatggactcagccttgcaaatagccagtgctagttctgacccaaccacagaggatgctgacatcatttgtattatgttccaaggctactacagagaaggctgcctgctatgtatttgcaaggctgatttatggtcagaatttccctctgatatgtctagggtgtgatttaggtcagtagactgtgattcttagcaaaaaatgaacagtgataagtatactgggggcaaaatcagaatggaatgctctggtctatataaccacatttctaagcctttgagactgttcctgagccttcagcactaacctatgagggtgagctggtcccctctatatatacatcatacttaactttactaagtaatctcacagcatttgccaagtctcccaatatccaattttaaaatgaaatgcattttgctagacagttaaactggcttaacttagtatattattattaattacaatgtaatagaagcttaaaataaagttaaactgatgaattatttcagaagtaaatgggtattcaagataaacaatgaaaggaggaggaaaaaataggcactcatacgtaatctatatattaaaacgctattgagaactcagtagccagttgacctgtggagatcctctagagc

SEQ ID NO: 454796 - DNA, 480 bp, Homo sapiens
gtgacatgatgggaagcttctaacataacgaaaactagcgtgagactgagaacctgaagacttcaactctggccctagcttctctgtatttggatctcccagacaggcatccatctatcccacagtgagtgccttgtggtctgaaacgagatcaaaggtggaaaaagctttaaaaagctctcttcaaaaacaagaatgtcacaagaggctgactctcgagactgtgttcccctacccctgcctcctacagagtttcattcagcagaccttgctacctgccttcttcagggaaaataatcttgtttttgagtttatgtttaaactaaagttagttgattattttcttcaacccttgtttttcttgttcatagagtttcttaatgtcacgagcgttcacctgttcaaggagagatgggacactaacaaggtggaccaccacactgacaagtatgaaaacaacaagctgattgtccgcagagg

SEQ ID NO: 454797 - DNA, 2702 bp, Homo sapiens
  misc_feature (15)..(15): n is a, c, g, or t
  misc_feature (24)..(24): n is a, c, g, or t
acagcattttccacntcaaagtcnatgtcaacgttggaccttgatttcatgacaccttctgtgttgaggggctttttagctccgtacatcagggcagtttctagggccaatctctcttctgcctgaccttcctgttggatttggaggctggcaagctgtggacagcaccccccaggaaaatagcgatggcatgtatcggtgtggccccgcctcggttcaagccatcaagcacggccatgtctgcttccaatttgatgcaccttttgtttttgcagaggtcaacagcgacctcatttacattacagctaagaaagatggcactcatgtggtggaaaatgtggatgccacccacattgggaaattaattgtgaccaaacaaattggaggagatggcatgatggatattactgatacttacaaattccaagaaggtcaagaagaagagagattggccctagaaactgccctgatgtacggagctaaaaagcccctcaacacagaaggtgtcatgaaatcaaggtccaacgttgacatggactttgaagtggaaaatgctgtgctgggaaaagacttcaagctctccatcaccttccggaacaacagccacaaccgttacaccatcacagcttatctctcagccaacatcaccttctacaccggggtcccgaaggcagaattcaagaaggagacgttcgacgtgacgctggagcccttgtccttcaagaaagaggcggtgctgatccaagccggcgagtacatgggtcagctgctggaacaagcgtccctgcacttctttgtcacagctcgcatcaatgagaccagggatgttctggccaagcaaaagtccaccgtgctaaccatccctgagatcatcatcaaggtccgtggcactcaggtagttggttctgacatgactgtgacagttgagtttaccaatcctttaaaagaaaccctgcgaaatgtctgggtacacctggatggtcctggagtaacaagaccaatgaagaagatgttccgtgaaatccggcccaactccaccgtgcagtgggaagaagtgtgccggccctgggtctctgggcatcggaagctgatagccagcatgagcagtgactccctgagacatgtgtatggcgagctggacgtgcagattcaaagacgaccttccatgtgaatgcacaggaagctgagatgaaccctggcatttggcctcttgtagtcttggctaaggaaattctaacgcaaaaatagctcttgctttgacttaggtgtgaagacccagacaggactgcagagggccccagagtggagatcccacatatttcaaaaacatgcttttccaaacccaggctattcggcaaggaagttagtttttaatctctccaccttccaaagagtgctaagcattagctttaattaagctctcatagctcataagagtaacagtcatcatttatcatcacaaatggctacatctccaaatatcagtgggctctcttaccagggagatttgctcaatacctggcctcatttaaaacaagacttcagattccccactcagccttttgggaataatagcacatgatttgggctctagaattccagtcccctttctcggggtcaggttctaccctccatgtgagaatatttttcccaggactagagcacaacataatttttatttttggcaaagccagaaaaagatctttcattttgcacctgcagccaagcaaatgcctgccaaattttagatttaccttgttagaagaggtggccccatattaacaaattgcatttgtgggaaacttaaccacctacaaggagataagaaagcaggtgcaacactcaagtctattgaataatgtagttttgtgatgcattttatagaatgtgtcacactgtggcctgatcagcaggagccaatatcccttactttaaccctttctgggatgcaatactaggaagtaaagtgaagaatttatctctttagttagtgattatatttcacccatctctcaggaatcatctcctttgcagaatgatgcaggttcaggtcccctttcagagatataataagcccaacaagttgaagaagctggcggatctagtgaccagatatatagaaggactgcagccactgattctctcttgtccttcacatcacccatgttgagacctcagcttggcactcaggtgctgaagggtaatatggactcagccttgcaaatagccagtgctagttctgacccaaccacagaggatgctgacatcatttgtattatgttccaaggctactacagagaaggctgcctgctatgtatttgcaaggctgatttatggtcagaatttccctctgatatgtctagggtgtgatttaggtcagtagactgtgattcttagcaaaaaatgaacagtgataagtatactgggggcaaaatcagaatggaatgctctggtctatataaccacatttctaagcctttgagactgttcctgagccttcagcactaacctatgagggtgagctggtcccctctatatatacatcatacttaactttactaagtaatctcacagcatttgccaagtctcccaatatccaattttaaaatgaaatgcattttgctagacagttaaactggcttaacttagtatattattattaattacaatgtaatagaagcttaaaataaagttaaactgat

SEQ ID NO: 454798 - DNA, 558 bp, Homo sapiens
aacacaggcattagccacaaggtaaacatcagagccagcagagccagcagtgtcatcttcctgaagtagaaaaaaacagctatcaattaaaacaatcacccaccagtataacaatgaagagtatcaccataaaccaaggcaaataaatgatcttgccaggaaagagatttagaggtgtaaagagagagctgagaaactagaaagccaatttgctgaaaagaggttcagtgtttaagattagttcccttatcgctttcatctacactcatgtcttttactgttttgtcctaagcaaatgtggtcaggaaaatgtgtgagttatagttaatgttcttaaccaatcaaattactagccgagtgtaatggtgcactcctgtagttccagatactcaggaggctgagggttacttttagacaagtattttatatgtattattggaagtattattaataggatctgttgttacattttctatctagtaattgttgcaaaaccagaatacttaaaacatcacatgtaatttttaaaaaccctatctctacttaatggaaaaaata

SEQ ID NO: 454799 - DNA, 336 bp, Homo sapiens
tgagacagagtctcgcactgttgcccaaggctgaagtacagtggtgcgatctccgctcactgcaacctccgcctcccaggttcaagcgattttcctgagtagctggggttacaggcgcctgccaccacacccggctaattttttgtatttttactagagatggggtttcactatgttggccaggctggtcttgaactcctgacctcttgatccgcctgcctcagcctcccaaagtgctgggattacaggcgtgagccaccgcgcctggccagctttgtttttttaaggagggttacttttagacaagtattttatatgtattattggaagtattat

SEQ ID NO: 454800 - DNA, 2995 bp, Homo sapiens
ctccgccgccgcctcgggaggtgaggacgaggaggaagcgagcagcccagacagcggccacctcaaggatggaatccgacgtggtaggcccagagcagatactgtccgcgatttaataaatgaaggagagcattcatccagcagaatccgttgtaacatctgtaatagggtgtttccacgggagaaatcgctccaggctcacaaaaggactcatacaggtgagaggccctatctgtgtgactatccagactgtggaaaagcctttgttcaaagtggacagctcaaaacacatcagcgtcttcacaccggagagaaaccttttgtttgttcagtggctgcctgagcagattcacccatgcaaaccgccactgtccgaagcacccctacgccaggctgaagagagaggagcccacggacacactcagcaaacatcaggctgccgacaacaaggccgcggccgagtggctggcgaggtattgggaaatgagagagcagcgcacccccactttgaaaggcaagctggttcagaaggctgatcaggagcagcaggaccctctggaataccttcagtctgatgaagaggacgacgagaagagaggggcccagcgccggctgcaggagcagcgggagcgcctgcatggagccctcgcgctcatagagcttgccaacctgactggggcgccactccgacagtagcttggacactgactcttccactgtacaaaagtactgcccagcatacttaaaaagtagatccttgggcataagctaagcaccttatttgcttatcataggctgctattctgtagaaatttatgaagaatgttattgccccagaatatggggtgagagagaactgcacttttttaatatggaaatgaattcatcgtaaagtttaaaatattttgtaaatatggactgcacagtacagggtagaaaactacatattgtgggaagctagattttgcaagtttaatgcattcattggaagcagttctcacaggaagcactttctgaataagacacttgtttgaaaaacagaatggtacaaatagccaaagaagattaaaacagattatttataagatcatttttaacaatatatattagtatgtttaacaatactgtaaacactgaagcaagcaagaaagtataaaatatgtaagatagataattttaattgcaaaatactgtgcccactaaggctagagaaatgggaggctattttggaagatgttctaagtaatggacttagaagaaaatagatatttgaggctcttggtaagatgcacaatagttcagaatttttgaaattggagcaaaatcagtcttattctatctggggctttacaactcagtataatgtttaagtttgaaaagcacttgtcatccctagcatgttaacttgggaacttttgcacatttcatatttctcatttgctgaaattgagtgattaatcttgcaaagtctaggtaacatagtaattggtaattttaaaaatacatattaagggccctgtaatgagatttggcacttggatttttactaaagggacacctgcagggttgtttgtagtgaaatgttttagatctttgttagcaaacactacattttaattgtactgcttgtttagaattattagcaaatggaagcctccatatttatattttcagtgcataaagccaccttcttgctttacttcagagtaacatgccaagctattttgtgttcactaaatttagctatcagttaaacactgcagaaaatattagctactcaaataagtaggcttctgaaatagttttaactgcaagtgtgttaacttgtgtggtggtttgaagccatttttccaaataaagttattaaacaccactttatgtactgaagcatgaacagaaaaatcaagagctgagcagaccacctcctttatgtaggcaaaacttccatcattttggctttgttctaaacagaactaaatgacatgcatagcatggtaacttacagatcgcttaattggagtaaaactcagagtaatagagggaaatatgggctcttcagtgcctttttagcttttttgagttgaagacgttcctacagatgtagtttaaacattacaaagtaggcttctttatccaaaaatcccaatgtgtcatagtacacagatagtttaaaatatgtagccacggggaaggggaggcatgtaaatgtcttgaagaggagaaaaagtatgaaagaagatacgatagttacgaataatgtgtatgatgaggacatactttaaaaatgtaattcctctgtacagtaaattacaaatctttagggatttttttgtaataagagaatttatatttgtaatggtctaagaatttttttgtaatgtggtatatagaattttaatttggagcacttataagctggtaagagagactatagcatctgaattatcttggtttatgtttcagcatttcctctagaatttttgctctcaaatatgtgatttaatgaactaaaaacaacactcatcagtcttgggaaatttgaactttgatcaacttaactaaagaaggaagggtagtaagaatttttcaaatacaaatatttgccaattcacagatgataacatttaaggccttcaaaagtaagggtttttccttgtttctccagtcagcttttgtcaactctaatagttttttcataaacattttttatttgtataattgcaacagtttaagaaattatcacaactatttagaaacatttaaaatgttctttttgatataagctatatacttggaaaaatacattggtatctaaaatttgaggtgtgttaagactgctttttgttttaaaaaatggtttacattcaaatttttgaagtgttttatgcttcatatggctaagttgtagtttggcagagttaacagcataagaataaacatgctgtaattttaaaagatgctttgaataaaaatttattttaatttaaaaaaaaaa

SEQ ID NO: 454801 - DNA, 473 bp, Homo sapiens
tcctgagtagctgggattacaggcagagaccaccacacccggctaattttcgtatttttagtagagatggcattttgccgtgttggccaggttggtctctagctcctgatctcaagtgattcgcctgcctcggcctcccaaagtgctgggattacaggcgtgagccaccacgccctgccattttgaacattttgaactcatgctaataaatcactttccaatggtgttggacacacatggccacgaccaaaatgtgactgtcttcctgtccccgctctagcactgatgagactgtgctggtttgattgttttctcctccaaattatagatcctaaatttcaccatattaatttacttttctggataccagtgaaactgaatgttttccacatgtctatgtgctggatgtccagatcctgacaggtgttaaccttgtgttttgaaggctgcctgagcagattcacccatgcaaa

SEQ ID NO: 454802 - DNA, 273 bp, Homo sapiens
ccccagcagatagtcattgatgccacccaagtgctgccattagcatttccacctgcagctcagtaggggccatgacatgttttattgttattgggagtcatgacctatataaaggctgattctctccccatccccctcctcttctggccttattatctcagatataatatctaacatctgtctacttaggtgagaggccctatctgtgtgactatccagactgtggaaaagcctttgttcaaagtggacagctcaaaacacatcagcgtcttc

SEQ ID NO: 454803 - DNA, 847 bp, Homo sapiens
  misc_feature (825)..(825): n is a, c, g, or t
  misc_feature (827)..(827): n is a, c, g, or t
  misc_feature (835)..(835): n is a, c, g, or t
gcatagctgaacgactctcttaatcctccaccgctacacgatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctaaaaaaacaaaaaagagaacaananaaaagagncggaaaatcgtg

SEQ ID NO: 454804 - DNA, 1012 bp, Homo sapiens
  misc_feature (1)..(1): n is a, c, g, or t
  misc_feature (118)..(118): n is a, c, g, or t
  misc_feature (121)..(121): n is a, c, g, or t
  misc_feature (125)..(125): n is a, c, g, or t
  misc_feature (144)..(145): n is a, c, g, or t
  misc_feature (155)..(155): n is a, c, g, or t
  misc_feature (163)..(163): n is a, c, g, or t
  misc_feature (180)..(181): n is a, c, g, or t
  misc_feature (194)..(194): n is a, c, g, or t
  misc_feature (197)..(197): n is a, c, g, or t
ntcattacttcgatcgctggttctttcagtgcaagtcccctgtttaacccgcagacggggtaagactactagggaatgggccgggccccctccagtcgcggatgaaaggttaaggccnaangccnttccagttaatggtacgcnntagtgttttnaccacatnttgaattaagtgcagtnntcttttaataacnccngtcgatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagacagatcggcctgaaacatcctcggccattatgagttctgaaattacaatt

SEQ ID NO: 454805 - DNA, 423 bp, Homo sapiens
taggatccagactgagcaatacaatctggcacttactggtttgtcttttttttcttacaaatagaatacctattatgttggttgggaataagaaagacctgcatatggaaaggtatgtagcttttataaagtcaaatctaagatgatttagtcactgaagtatcattttaattattgttctgatgtcaagaatatttttagctgtagcatttttatccgttcagaggtgttatggtcgtgtgcagcagaagcaaaagtggaatagaaatctcacattcctctagaaaagagagagcaaactttataggaaactacctttaggttatctgccactttgcataaagcaaattctaaaaagacatagtgctcatttatgcagcaagtggtttttgagtaccagggtttgggatttagtgtaggagc

SEQ ID NO: 454806 - DNA, 2282 bp, Homo sapiens
aaccggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgcaaaaaaaataa

SEQ ID NO: 454807 - DNA, 1617 bp, Homo sapiens
aaccggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaataggatgcggcaaggtttctccctctttctgcaaccaatgtgacaaattgaaattaa

SEQ ID NO: 454808 - DNA, 1614 bp, Homo sapiens
aaccggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagacagatcggcctgaaacatcctcggccattatgagttctgaaattacaatt

SEQ ID NO: 454809 - DNA, 1847 bp, Homo sapiens
  misc_feature (1791)..(1791): n is a, c, g, or t
aaccggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagaaaaaaaaaaaaatggcctccttggcctaaaagctggagatctgagggcgcttaactttagtgggggtaattcattatcctcgctgattgccccgctcatcttaagtcttccgctgccggagagcggctctaagacaatcatatggcgtgccttaggactccccgagaattatgggtatatcgcaggatgtaacctagagtaaaaggacattaaaaggttggaacctntaaacagccgcggtgatgggagtaatacaataagttcctcaccctacgaaccaacg

SEQ ID NO: 454810 - DNA, 1620 bp, Homo sapiens
aaccggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagcaagaacgcgacacgcttttgtcctccccttctcctacatattaaaccgcgacaaaa

SEQ ID NO: 454811 - DNA, 1619 bp, Homo sapiens
  misc_feature (1566)..(1566): n is a, c, g, or t
aaccggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagcangatgcggccgaccatcctatcactgtggatacttttgaataattcacataata

SEQ ID NO: 454812 - DNA, 2374 bp, Homo sapiens
aaccggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtgggttcctcaagccaggacctacgcacctgttgtgagtggtgttatagttctgcagggcgcacaggtgcatccccatgggcacatttaatttagggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgcaaaaaaaataa

SEQ ID NO: 454813 - DNA, 1844 bp, Homo sapiens
aaccggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaagggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgcaaaaaaaataa

SEQ ID NO: 454814 - DNA, 1878 bp, Homo sapiens
ccaatcaacatccaaccccaatcaactcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtgggttcctcaagccaggacctacgcacctgttgtgagtggtgttatagttctgcagggcgcacaggtgcatccccatgggcacatttaatttagggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgcaaaaaaaataa

SEQ ID NO: 454815 - DNA, 1776 bp, Homo sapiens
agcgggccgccgaggagtccgggtctcgtctggggaagtgaggcggcgccggggagccacgctagaggctgccgcgagggagtcacacctgcctccccgccttcgccgcgggcgcgcgtgaccggggctggcggtctcccccaccccgcccccgatggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgcaaaaaaaataa

SEQ ID NO: 454816 - DNA, 1674 bp, Homo sapiens
  misc_feature (18)..(18): n is a, c, g, or t
cgactccgtaggcgcggngggcggctcctgctcttcctggactcctgagcagagggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgcaaaaaaaataa

SEQ ID NO: 454817 - DNA, 2234 bp, Homo sapiens
aaccggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacattgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgcaaaaaaaataa

SEQ ID NO: 454818 - DNA, 1790 bp, Homo sapiens
gtctctttgaaaaagaatcaaggtttaccaagcttgattttagccagtcaccgtatttcctagctaaataatggaagtaggggagaatctatacaagtcagagagttgttcttttttgtttcatggggcctttctctgagactgctagggactctgtgcttgattggttgtcattgttcaaacttcaggtggtttcgagttaatttttttaaactaatgtttaatttcctttttccctgtagcttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgcaaaaaaaataa

SEQ ID NO: 454819 - DNA, 1620 bp, Homo sapiens
gtctctttgaaaaagaatcaaggtttaccaagcttgattttagccagtcaccgtatttcctagctaaataatcttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgcaaaaaaaataa

SEQ ID NO: 454820 - DNA, 1583 bp, Homo sapiens
  misc_feature (30)..(30): n is a, c, g, or t
cgtgatgttatcgcccaacaccaaccatanaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgcaaaaaaaataa

SEQ ID NO: 454821 - DNA, 2142 bp, Homo sapiens
aaccggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtgggatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgcaaaaaaaataa

SEQ ID NO: 454822 - DNA, 1519 bp, Homo sapiens
gcatagctgaacgactctcttaatcctccaccgctacacgatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgcaaaaaaaataa

SEQ ID NO: 454823 - DNA, 1560 bp, Homo sapiens
ctcaggatggtggcacacaggcatgtcctgccgtggtttcacccttcattctgttgaaaactggatgataacaaactcaggatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgcaaaaaaaataa

SEQ ID NO: 454824 - DNA, 2922 bp, Homo sapiens
gttcattagacgcacgtcactaggtccatgcagggagatgacacacagtgtggccactaggagagcaggagatctgggagccggctccaagctgcctgccacacagtcctagttctttcagtctgtttctcacgtgacaggttactgtatttttgcccaagtggcgacacttttaaagataggcaaatacagcatgcggaggaaaccgtggttctgtaatgcaaccgcaggtccttaggacacccatatcccatttgttgacccacagcgagcttgtaggggggttaaatttcatttttgtttttatcaaatgacagcacacatcgtttaaaatagcacagtgtgtaattcattcaacaagctaacttattctgaagcttgtgatgcaatcatgaacaaagcagacaaatccctgcccttgcggacctattatttctggtgtgggagacaaacagtaaaacgacacacatgcgagataggatgtctgtgaccatgctgccaagaaaaataaagtacggaaggggtaagaaatggaaaggaaatttgtcatttagggtaaacagaagaggtgtaagaagtgacatttgaggctgggtgtggtggctcacgcctgtaatcccagcactttgggaggccgaggcaggcggatcacgaggtcagaagtttgcggcttgagagtcactggggccgagtaaagatggccacccatcagaggatgttgaaccaggcaccgtccatctgctgcagcagagtcctctggttgctgtgctgagcaggggtggcggggaagggttggggctgtggaactgatgcaggcagacttgggccaggaattcacacctcagcggcagcagtggaggggagtgagaagccgtcagattctaggtaggatttgaaagtagagccagtgatgtgctggcagatgtttgcatgggttttttgggggagggtggaaaatgatttgtggccatttgccagcagtcagtggtataaataatcctgctgtggcagatttcaagtgatcattatgacatctcagatccccttcccggtgagagccacctccatcctagagtcatcggctcattgatctgattgaaagccaagagatactggcatcacccagagaatgtatgtacctaggaaagaacacaggagcaggctgaatgtactagggcactctaggaaaagctgttcaagttgtaatgtaaacagttggttctttgctgaatgagttgggtgattaaaatttgcatttatgtggtttctcagcccagtggtaggctttccgtttgaatgccttacctgtttcactttgaatatcctcagtcagggttgctgagtgtcagatgtatgcacatgtgaatggattgctaggaaaaaacaggagttctttgtgttcattttatgttatgttaaaatggtgagtctgtgacattttacatttttccagctggcaacataacatacatttaaaaacttcaacattaaaatggatgtctaatttatactttttgttttatagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgcaaaaaaaataa

SEQ ID NO: 454825 - DNA, 1404 bp, Homo sapiens
taggatccagactgagcaatacaatctggcacttactggtttgtcttttttttcttacaaatagaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgcaaaaaaaataa

SEQ ID NO: 454826 - DNA, 1350 bp, Homo sapiens
tcccccgggctgcaggattcggcacgagtgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgcaaaaaaaataa

SEQ ID NO: 454827 - DNA, 1147 bp, Homo sapiens
aaccggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagtaagtgacctctggtatctcagaatcttatacagcatatctgacagtcttggtcctagcactgatttttaaaagtaccagctatgccaagaaaacccctcaggttgtgtgcagacagtccctgactcccaatggtttggcttgcagtggctcgacttaacaatttctcatctttacgatgggtctattgaggtatttgatacattttcaactcatgatatttttggtttacagtaggtttatcacgatgtaaccccatcataagtcaaggagcttacacagataactaaatgttagtatgctgtctacttggtcttttctaagacatttctggcagttatcttt

SEQ ID NO: 454828 - DNA, 740 bp, Homo sapiens
  misc_feature (361)..(362): n is a, c, g, or t
  misc_feature (507)..(507): n is a, c, g, or t
aaccggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaaggtgggagggtcatgacgcagcgagtttcagtcgtgacttttctgggggcatcgcggcgtcccctttttttgcctttaaagtcacggcgcgaagaggggcggtgctgacgccggccggtcacgtgggcgtgttgtggnnttttttttttttttcttttcttcttcttctctttttctttccttcctcctttttcctttccccctcttcctttccccctctttgtcctctcctccccctcgctccttttccctttcctctccttccctcctcctttccctctctnctcccttgttcttccctttcgttctctcctccgtcgtcccttccgttcccctctctgttcctgtctcccctgttccttcctctcttttttcccgcttcctccccccttcgcctttcttcttcctcgtctttgtcgttctccgctttcgctccgctctctctcctttctcgcctccgcgcctcgctgccctttccttccccgcgtttacctgcctcccctatcgctcttctctc

SEQ ID NO: 454829 - DNA, 302 bp, Homo sapiens
tctgatgtgcttgttggtcagtaatatttgttaatgtcacagacatgtttactttgtaatagcttaattgcataatatcctcatataaagcaaattaatgaaatttatttcattttttgaaattgctcacatgctaattaaatgaatgttttctgaccctgataccttcagtgtcttcatctattaatggttttttaataaaacagcaaaattaaaaatttttaccttcatatgccaacacacactaagctcttgttctcttttatagggaaatcctcattgacgattcaatttgttgaagg

SEQ ID NO: 454830 - DNA, 473 bp, Homo sapiens
cgacgtgttgtgtctgagatcccggtgctgaagactaacgccggaccccgagatcgtgagttgtgggtgcagcgactgaaggaggaatatcagtcccttatccgggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagtttggaagtgatggttccccgcagcggggaacaatcacttttgctaggcaacctagcaaaagtgaacaaataggattacatgaagtgaaaaagcttatgtacagcaaaggaaacaatcaacaaagtgatggttccccgctgggtac

SEQ ID NO: 454831 - DNA, 1617 bp, Homo sapiens
aaccggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagtagatgcggccagctttcatcttctttgttggatacggtgaaaacgagatatac

SEQ ID NO: 454832 - DNA, 1610 bp, Homo sapiens
  misc_feature (1588)..(1588): n is a, c, g, or t
  misc_feature (1590)..(1590): n is a, c, g, or t
  misc_feature (1598)..(1598): n is a, c, g, or t
aaccggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctaaaaaaacaaaaaagagaacaananaaaagagncggaaaatcgtg

SEQ ID NO: 454833 - DNA, 1625 bp, Homo sapiens
aaccggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaataggatgcggccggccccccccaccatcaatcttttattttaaactttttaatttatactgagta

SEQ ID NO: 454834 - DNA, 1630 bp, Homo sapiens
aaccggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagtactggttatgcgagcaagctctctattttttttcttgtctgtatatgccgatcgctaactccgtat

SEQ ID NO: 454835 - DNA, 1626 bp, Homo sapiens
aaccggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagcagagatgcgttccgcttctatacttaacttttattgtgttgtctaatattatttaaataaga

SEQ ID NO: 454836 - DNA, 2186 bp, Homo sapiens
aaccggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgcaaaaaaaataa

SEQ ID NO: 454837 - DNA, 2228 bp, Homo sapiens
aaccggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaatgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgcaaaaaaaataa

SEQ ID NO: 454838 - DNA, 2225 bp, Homo sapiens
aaccggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgcaaaaaaaataa

SEQ ID NO: 454839 - DNA, 1301 bp, Homo sapiens
aaccggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaaggtatgtagcttttataaagtcaaatctaagatgatttagtcactgaagtatcattttaattattgttctgatgtcaagaatatttttagctgtagcatttttatccgttcagaggtgttatggtcgtgtgcagcagaagcaaaagtggaatagaaatctcacattcctctagaaaagagagagcaaactttataggaaactacctttaggttatctgccactttgcataaagcaaattctaaaaagacatagtgctcatttatgcagcaagtggtttttgagtaccagggtttgggatttagtgtaggagc

SEQ ID NO: 454840 - DNA, 777 bp, Homo sapiens
gcggagtattccaggcgcctgcaactaaacgtggccgggtctgcaagctaggtgccagcggggaaagtttccctgcttcttatcgtctgctttaacgccttaaatagcccgctgaaggctgcagcaggtgctaggtagcagcctcccggccctcgggaaaggcggggtggggaggcgagagcagcttagcctcctcgacctcccttcctggtgacggacgaacagttcccgtagaatttcgcttcaccgagtgaccttgagcccagggcgacggtcagcttgttaattcctggctgcaggaactttgtgagaattttaatgcatggaaaagctgtccatgttccaactgctgtacatccaaaagtctcagtgtaatagcaggaccaaaatattctgtcaatcagctgaccatatacttaatgactcctaaaatctcgtggacttctaagaaagcgccatggcctgtgctgctgttatgattcctgggttgttgcggtgctctgttggagccatccgtattgaggctgcgtcactgagattgacactcagcactttgcgccaccttactctaaccagcataatgaaatccaaaaggaaaactgatcacatggagagaactgcaagtgtccttcgacgggagagcaacttatttcatcaagggagaaagcactaacatctgagaaaggaaagtggacgagctcttgttacccttctaatgtacagattttttccaccatattcagactatagaaagctaatctaccacctgaaggggtg

SEQ ID NO: 454841 - DNA, 709 bp, Homo sapiens
acggggtttcaccctgttggtcaggttggtctcaaactcctgacctcaggggatccacctgctttggcctcccaaagtgctgggaaaaattattaactcaatcctttaacttgttatgggtctgctcagattttctttcttcttgagtcagatttggtagtttatgtcattttaggaatgtgtgcatttcatgtaagttagctaattttttggcatatagttgttcatggaattcctttataattctttttatttctataagctttgtgatgatatctcctcttttattcttgattttagtaattttttttcatagtcttgcaaaggtttgtcaattctgtttaatttaccaatttttaaaattgcttcaacaataatcatttatttggctttctttttagggttgatttctttattccaggagtctctgtggttggtgggttttcaatatgctccagtcccagactgctagaacaagagagagtgatagaattggcagtgaaatatacgaaccaccctcctgccctctgggttcacaatacggtaagcacactgcctgtttaaacgcgatgatctgggtatctctgccacccacaaaatttgtgttaagctcatttgattcacctaagaaacctgggcttgagtaaaagggtacatgcccagaaagagcttctaagaaaggtcaaagaaactttgatgcattaagtat

SEQ ID NO: 454842 - DNA, 1515 bp, Homo sapiens
gcggagtattccaggcgcctgcaactaaacgtggccgggtctgcaagctaggtgccagcggggaaagtttccctgcttcttatcgtctgctttaacgccttaaatagcccgctgaaggctgcagcaggtgctaggtagcagcctcccggccctcgggaaaggcggggtggggaggcgagagcagcttagcctcctcgacctcccttcctggtgacggacgaacagttcccgtagaatttcgcttcaccgagtgaccttgagcccagggcgacggtcagcttgttaattcctggctgcaggaactttgtgagaattttaatgcatggaaaagctgtccatgttccaactgctgtacatccaaaagtctcagtgtaatagcaggaccaaaatattctgtcaatcagctgaccatatacttaatgactcctaaaatctcgtggacttctaagaaagcgccatggcctgtgctgctgttatgattcctgggttgttgcggtgctctgttggagccatccgtattgaggctgcgtcactgagattgacactcagcactttgcgccaccttactctaaccagcataatgaaatccaaaaggaaaactgatcacatggagagaactgcaagtgtccttcgacgggagattgtggcagcagctaaggtgtgtggagctgccagtgagtcaccgtcagtgaagagcctccgcttgcttgttgctgatcaagacttttcctttaaagctggccagtgggttgatttctttattccaggagtctctgtggttggtgggttttcaatatgctccagtcccagactgctagaacaagagagagtgatagaattggcagtgaaatatacgaaccaccctcctgccctctgggttcacaatacgtgtacacttgactgtgaagtggctgtgagagtgggtggagagttcttctttgaccctcagcctgcggatgcctctagaaacctcgtgttgattgcaggaggagtcggaattaaccctctgctttccatcctgcggcacgcagcagatctcctcagagagcaggcaaacaaaagaaatggatatgagataggaacaataaaactattctacagtgcaaaaaataccagcgaactcctgtttaagaaaaatatccttgatttagtaaatgaatttcctgagaagattgcatgcagtttgcatgttacaaaacagactacacaaatcaatgcggaactcaagccatacatcacggaaggaagaataacggagaaggagataagagatcatatttcaaaagagactttgttctatatttgtggcccacctccaatgacagactttttctccaagcaactggaaaacaaccatgtacccaaagaacacatttgctttgagaagtggtggtaggaggcagacaaaggcagaaaaaataaagagcaagtagagcagcaactgagggagccatcctcacagacttgtggcagcagctaaggtgcgtagacatgacgggatcctctagatcacct

SEQ ID NO: 454843 - DNA, 1119 bp, Homo sapiens
gcggagtattccaggcgcctgcaactaaacgtggccgggtctgcaagctaggtgccagcggggaaagtttccctgcttcttatcgtctgctttaacgccttaaatagcccgctgaaggctgcagcaggtgctaggtagcagcctcccggccctcgggaaaggcggggtggggaggcgagagcagcttagcctcctcgacctcccttcctggtgacggacgaacagttcccgtagaatttcgcttcaccgagtgaccttgagcccagggcgacggtcagcttgttaattcctggctgcaggaactttgtgagaattttaatgcatggaaaagctgtccatgttccaactgctgtacatccaaaagtctcagtgtaatagcaggaccaaaatattctgtcaatcagctgaccatatacttaatgactcctaaaatctcgtggacttctaagaaagcgccatggcctgtgctgctgttatgattcctgggttgttgcggtgctctgttggagccatccgtattgaggctgcgtcactgagattgacactcagcactttgcgccaccttactctaaccagcataatgaaatccaaaaggaaaactgatcacatggagagaactgcaagtgtccttcgacgggagattgtggcagcagctaaggtgtgtggagctgccagtgagtcaccgtcagtgaagagcctccgcttgcttgttgctgatcaagacttttcctttaaagctggccagtgggttgatttctttattccaggagtctctgtggttggtgggttttcaatatgctccagtcccagactgctagaacaagagagagtgatagaattggcagtgaaatatacgaaccaccctcctgccctctgggttcacaatacgtgtacacttgactgtgaagtggctgtgagagtgggtggagagttcttctttgaccctcagcctgcggatgcctctagaaacaaagcagatgaaagaataaaggaaatagataccttttgaatttgaggggtgttgagccatgaatggcacatacctgcatagctcccgagtcaaacctattcaaggctttccagaaatcagatacatcatgtaaaaatagtgcttctcaa

SEQ ID NO: 454844 - DNA, 521 bp, Homo sapiens
ctaggtgccagcggggaaagtttccctgcttcttatcgtctgctttaacgccttaaatagcccgctgaaggctgcagcaggtgctaggtagcagcctcccggccctcgggaaaggcggggtggggaggcgagagcagcttagcctcctcgacctcccttcctggtgacggacgaacagttcccgtagaatttcgcttcaccgagtgaccttgagcccagggcgacggtcagcttgttaattcctggctgcaggtacattccgcttcttcctcaccccagacgccttaaaataccctaaattgtgttgctgaaaggaccaagccctggaaggcagggattgagttctagtcttctgtttgccaggcttataacattattaacgacgatgatttttagtaatagtaataacatcaccttttattattgggaagttatgtgccagctattgcactaagtggaattgtcaactctaggagtttacatgttattccattttattaatctttaaactgaggtacaga

SEQ ID NO: 454845 - DNA, 1844 bp, Homo sapiens
gcggagtattccaggcgcctgcaactaaacgtggccgggtctgcaagctaggtgccagcggggaaagtttccctgcttcttatcgtctgctttaacgccttaaatagcccgctgaaggctgcagcaggtgctaggtagcagcctcccggccctcgggaaaggcggggtggggaggcgagagcagcttagcctcctcgacctcccttcctggtgacggacgaacagttcccgtagaatttcgcttcaccgagtgaccttgagcccagggcgacggtcagcttgttaattcctggctgcaggaactttgtgagaattttaatgcatggaaaagctgtccatgttccaactgctgtacatccaaaagtctcagtgtaatagcaggaccaaaatattctgtcaatcagctgaccatatacttaatgactcctaaaatctcgtggacttctaagaaagcgccatggcctgtgctgctgttatgattcctgggttgttgcggtgctctgttggagccatccgtattgaggctgcgtcactgagattgacactcagcactttgcgccaccttactctaaccagcataatgaaatccaaaaggaaaactgatcacatggagagaactgcaagtgtccttcgacgggagattgtggcagcagctaaggtgtgtggagctgccagtgagtcaccgtcagtgaagagcctccgcttgcttgttgctgatcaagacttttcctttaaagctggccagtgggttgatttctttattccaggagtctctgtggttggtgggttttcaatatgctccagtcccagactgctagaacaagagagagtgatagaattggcagtgaaatatacgaaccaccctcctgccctctgggttcacaatacgtgtacacttgactgtgaagtggctgtgagagtgggtggagagttcttctttgaccctcagcctgcggatgcctctagaaacctcgtgttgattgcaggaggagtcggaattaaccctctgctttccatcctgcggcacgcagcagatctcctcagagagcaggcaaacaaaagaaatggatatgagataggaacaataaaactattctacagtgcaaaaaataccagcgaactcctgtttaagaaaaatatccttgatttagtaaatgaatttcctgagaagattgcatgcagtttgcatgttacaaaacagactacacaaatcaatgcggaactcaagccatacatcacggaaggaagaataacggagaaggagataagagatcatatttcaaaagagactttgttctatatttgtggcccacctccaatgacagactttttctccaagcaactggaaaacaaccatgtacccaaagaacacatttgctttgagaagtggtggtaggaggcagacaaaggcagaaaaaataaagaggtgagatctactcaggagagctcctgtcctttgtggcatgattaattttttttatctctacttgagttgtcttattttttaaggctataaacttagtgaccagctggataataaaagccagctggcagacttaaatgataaactttttgcaaagacctcagtgatcaaactattttttactatactgattttctgttattaacaacgatttaattgtctcatgatgtaccatgattggtcagtatagatttttcttttgtctttaggcaaaaaaaagatatatacttatgtctaatcataggaaaatgtgatttttgagtataaaatgtgggctagctttaaattatttgacagccatctatatatcttatgtttaatgaaagtataatttaaatacaatcttaataattttactttg

SEQ ID NO: 454846 - DNA, 1469 bp, Homo sapiens
gcggagtattccaggcgcctgcaactaaacgtggccgggtctgcaagctaggtgccagcggggaaagtttccctgcttcttatcgtctgctttaacgccttaaatagcccgctgaaggctgcagcaggtgctaggtagcagcctcccggccctcgggaaaggcggggtggggaggcgagagcagcttagcctcctcgacctcccttcctggtgacggacgaacagttcccgtagaatttcgcttcaccgagtgaccttgagcccagggcgacggtcagcttgttaattcctggctgcaggaactttgtgagaattttaatgcatggaaaagctgtccatgttccaactgctgtacatccaaaagtctcagtgtaatagcaggaccaaaatattctgtcaatcagctgaccatatacttaatgactcctaaaatctcgtggacttctaagaaagcgccatggcctgtgctgctgttatgattcctgggttgttgcggtgctctgttggagccatccgtattgaggctgcgtcactgagattgacactcagcactttgcgccaccttactctaaccagcataatgaaatccaaaaggaaaactgatcacatggagagaactgcaagtgtccttcgacgggagattgtggcagcagctaaggtgtgtggagctgccagtgagtcaccgtcagtgaagagcctccgcttgcttgttgctgatcaagacttttcctttaaagctggccagtgggttgatttctttattccaggagtctctgtggttggtgggttttcaatatgctccagtcccagactgctagaacaagagagagtgatagaattggcagtgaaatatacgaaccaccctcctgccctctgggttcacaatacgtgtacacttgactgtgaagtggctgtgagagtgggtggagagttcttctttgaccctcagcctgcggatgcctctagaaaaaaatatccttgatttagtaaatgaatttcctgagaagattgcatgcagtttgcatgttacaaaacagactacacaaatcaatgcggaactcaagccatacatcacggaaggaagaataacggagaaggagataagagatcatatttcaaaagagactttgttctatatttgtggcccacctccaatgacagactttttctccaagcaactggaaaacaaccatgtacccaaagaacacatttgctttgagaagtggtggtaggaggcagacaaaggcagaaaaaataaagagggctctgtgtccaaagaacatgaggaaccaagcgtgaggaatgcaggagtgatgccaggagtgaggagccgagcaggtcaggcaggccctgccgagaatgtggcctcagccatcaaagtgggaatatctgggcggcttgagcctccagaagagcctttcttcttcttctttttggcggcccaacaggacgatagcagacaagggcct

SEQ ID NO: 454847 - DNA, 4151 bp, Homo sapiens
gttcacgccctggctggtttggattcgagaggaaaaatcattaaaggatctggagttttcaccccaaaactttaatcgttttgtcccttctttttttttcttgtctttcctccagcagctgcagactacataatgaaaaataacaaaagtgcccatgcgcgaggctgtgcaactaaccacccgacgattgcggggaggaggagtaagagtcggctaagcggcgcccagtgtcctactgcgcctgtgcgccggtggcgtgcgcagaggcctctgggtaggtggctcaaccccgcctctcagttgaggactctgaaggctgtttctgtggcgcttcccctgcgaggatggctaccctggttgtaaacaagctcggagcgggagtagacagtggccggcagggcagccgggggacagctgtagtgaaggtgctagagtgtggagtttgtgaagatgtcttttctttgcaaggagacaaagttccccgtcttttgctttgtggccataccgtctgtcatgactgtctcactcgcctacctcttcatggaagagcaatccgttgcccatttgatcgacaagtaacagacctaggtgattcaggtgtctggggattgaaaaaaaattttgctttattggagcttttggaacgactgcagaatgggcctattggtcagtatggagctgcagaagaatccattgggatatctggagagagcatcattcgttgtgatgaagatgaagctcaccttgcctctgtatattgcactgtgtgtgcaactcatttgtgctctgagtgttctcaagttactcattctacaaagacattagcaaagcacaggcgagttcctctagctgataaacctcatgagaaaactatgtgctctcagcaccaggtgcatgccattgagtttgtttgcttggaagaaggttgtcaaactagcccactcatgtgctgtgtctgcaaagaatatggaaaacaccagggtcacaagcattcagtattggaaccagaagctaatcagatccgagcatcaattttagatatggctcactgcatacggaccttcacagaggaaatctcagattattccagaaaattagttggaattgtgcagcacattgaaggaggagaacaaatcgtggaagatggaattggaatggctcacacagaacatgtaccagggactgcagagaatgcccggtcatgtattcgagcttatttttatgatctacatgaaactctgtgtcgtcaagaagaaatggctctaagtgttgttgatgctcatgttcgtgaaaaattgatttggctcaggcagcaacaagaagatatgactattttgttgtcagaggtttctgcagcctgcctccactgtgaaaagactttgcagcaggatgattgtagagttgtcttggcaaaacaggaaattacaaggttactggaaacattgcagaaacagcagcagcagtttacagaagttgcagatcacattcagttggatgccagcatccctgtcacttttacaaaggataatcgagttcacattggaccaaaaatggaaattcgggtcgttacgttaggattggatggtgctggaaaaactactatcttgtttaagttaaaacaggatgaattcatgcagcccattccaacaattggttttaacgtggaaactgtagaatataaaaatctaaaattcactatttgggatgtaggtggaaaacacaaattaagaccattgtggaaacattattacctcaatactcaagctgttgtgtttgttgtagatagcagtcatagagacagaattagtgaagcacacagcgaacttgcaaagttgttaacggaaaaagaactccgagatgctctgctcctgatttttgctaacaaacaggatgttgctggagcactgtcagtagaagaaatcactgaactactcagtctccataaattatgctgtggccgtagctggtatattcagggctgtgatgctcgaagtggtatgggactgtatgaagggttggactggctctcacggcaacttgtagctgctggagtattggatgttgcttgattttaaaggcagcagttgtttgaagttttgtggttaaaagtaactttgcacatagtatgttttaagaaattatacatctcaaaagatggtaatttaggatgcatatatatatatatatatataaaggaatcttggattgggaattcagtactttgctttaaaaaaattttgtggcagaattaaatttctaattgagcagattagattgaattaaatagaaacttattgaatatacattcttttaaaaagtatatttgttatttaagtttttcagataatatgtgaccaatatactgggaaagaggtagtcacagagaaagggtaagtgaaggtttattctttcagtgaaaaaagaatagccaattgagtgcctaatgagacctctgtgtgaagcaagtgaagtatagctgcttcttttaacctgccttttcactgaatgttggcagcatttagtagtagaaatgacagttgcttaatgaaatagaatccaaactacatatttggataataggattactttatgtttatgttcagagttaacagaacacctttaatgctaagaactataaggtacagaaaattaatactttatatagtgttttattaactttctcctacagcattttgtataaaacacaatgagggagtgaaatgttacccaattaggcttgtcaggttagtaataaactgaacagtaataaaactgtggaagtaattggatctgaatttatgaaagacccatttccaggactgaacctaggtcagagctctaaattggtccttctatttttcaacaaatttaaagtaatatttctttctaatataatattgcatcctttgtgggaatgactataggtaaaatgtagtaagtaacgcagaaccagggttggctttatttaaaagctagtgacctaaatagaaagcgaacttcaagagaagttgtaagtacagtggcaaatgcttattacttacttcaaactgtttcccaaaataagtgcatttattttgacaataaaacttaaggctgttcatgagaaggccttgaaaagttactctagaggaaaaatgtctaaagaaaaaaaaaattcaaaaagtttacattaattattcagtgttgtgagtaaataaaaatgtgtgctctttactgtttttcatttttaaagaatattattatggaagcacgatttatttaaataggtacattgagacttttttttttaatgttctgatacattaggatgaagttaaatcttaaatcttattagttgaattgttgtaaggacagtgatgtctggtaacaagatgtgactttttggtagcactgttgtggttcattcttttcaaatctatttttgtttaaaaacaatacaagttttagaaaacaaagcattaaaaaaaaagcctatcagtattatgggcaatatgtaaataaataaatgtaatatttcatcctttatttttcaggtaaaaggtcatgctgttacaggtgtagtttgtgtgcataaataatacttccgaattaaattatttaatatttgactgatttcaataactgtgaaaaataaaaaaggtgttgtattgcttgtgagaacttgaactgtttactagttaattgaagaaaaagtgtaacactaaggtgaacttgcttcccttttcactaattttgctaaactttgtaatgcacattcttagcatataactgaacacagttgaaaaattgtgcctgattataatgtatgtataatggtaggtgtttgtgtgtgattcatttttaaagaaatatttttctcaagctcctattactatttgtggttgtattatttcactaatcattagttaagactgtgctagtcttccctgggaaactaagaagagagcttttttatatacagtatattagaattttcctagtagctgaatttctgtattaggtctaaatattactgtatgttatataaagcaggtatgtcaagtgtatagccgtagtctataattcaggaatgctttataaccatcagaagccattatttgcactacatatatgataagtatagacagcaataaaatgttaagatcattttt

SEQ ID NO: 454848 - DNA, 2639 bp, Homo sapiens
gttcacgccctggctggtttggattcgagaggaaaaatcattaaaggatctggagttttcaccccaaaactttaatcgttttgtcccttctttttttttcttgtctttcctccagcagctgcagactacataatgaaaaataacaaaagtgcccatgcgcgaggctgtgcaactaaccacccgacgattgcggggaggaggagtaagagtcggctaagcggcgcccagtgtcctactgcgcctgtgcgccggtggcgtgcgcagaggcctctgggtaggtggctcaaccccgcctctcagttgaggactctgaaggctgtttctgtggcgcttcccctgcgaggatggctaccctggttgtaaacaagctcggagcgggagtagacagtggccggcagggcagccgggggacagctgtagtgaaggtgctagagtgtggagtttgtgaagatgtcttttctttgcaaggagacaaagttccccgtcttttgctttgtggccataccgtctgtcatgactgtctcactcgcctacctcttcatggaagagcaatccgttgcccatttgatcgacaagtaacagacctaggtgattcaggtgtctggggattgaaaaaaaattttgctttattggagcttttggaacgactgcagaatgggcctattggtcagtatggagctgcagaagaatccattgggatatctggagagagcatcattcgttgtgatgaagatgaagctcaccttgcctctgtatattgcactgtgtgtgcaactcatttgtgctctgagtgttctcaagttactcattctacaaagacattagcaaagcacaggcgagttcctctagctgataaacctcatgagaaaactatgtgctctcagcaccaggtgcatgccattgagtttgtttgcttggaagaaggttgtcaaactagcccactcatgtgctgtgtctgcaaagaatatggaaaacaccagggtcacaagcattcagtattggaaccagaagctaatcagatccgagcatcaattttagatatggctcactgcatacggaccttcacagaggaaatctcagattattccagaaaattagttggaattgtgcagcacattgaaggaggagaacaaatcgtggaagatggaattggaatggctcacacagaacatgtaccagggactgcagagaatgcccggtcatgtattcgagcttatttttatgatctacatgaaactctgtgtcgtcaagaagaaatggctctaagtgttgttgatgctcatgttcgtgaaaaattgatttggctcaggcagcaacaagaagatatgactattttgttgtcagaggtttctgcagcctgcctccactgtgaaaagactttgcagcaggatgattgtagagttgtcttggcaaaacaggaaattacaaggttactggaaacattgcagaaacagcagcagcagtttacagaagttgcagatcacattcagttggatgccagcatccctgtcacttttacaaaggataatcgagttcacattggaccaaaaatggaaattcgggtcgttacgttaggattggatggtgctggaaaaactactatcttgtttaagttaaaacaggatgaattcatgcagcccattccaacaattggttttaacgtggaaactgtagaatataaaaatctaaaattcactatttgggatgtaggtggaaaacacaaattaagaccattgtggaaacattattacctcaatactcaagctgttgtgtttgttgtagatagcagtcatagagacagaattagtgaagcacacagcgaacttgcaaagttgttaacggaaaaagaactccgagatgctctgctcctgatttttgctaacaaacaggatgttgctggagcactgtcagtagaagaaatcactgaactactcagtctccataaattatgctgtggccgtagctgtttttcagataatatgtgaccaatatactgggaaagaggtagtcacagagaaagggtaaaaggtcatgctgttacaggtgtagtttgtgtgcataaataatacttccgaattaaattatttaatatttgactgatttcaataactgtgaaaaataaaaaaggtgttgtattgcttgtgagaacttgaactgtttactagttaattgaagaaaaagtgtaacactaaggtgaacttgcttcccttttcactaattttgctaaactttgtaatgcacattcttagcatataactgaacacagttgaaaaattgtgcctgattataatgtatgtataatggtaggtgtttgtgtgtgattcatttttaaagaaatatttttctcaagctcctattactatttgtggttgtattatttcactaatcattagttaagactgtgctagtcttccctgggaaactaagaagagagcttttttatatacagtatattagaattttcctagtagctgaatttctgtattaggtctaaatattactgtatgttatataaagcaggtatgtcaagtgtatagccgtagtctataattcaggaatgctttataaccatcagaagccattatttgcactacatatatgataagtatagacagcaataaaatgttaagatcattttt

SEQ ID NO: 454849 - DNA, 4280 bp, Homo sapiens
gttcacgccctggctggtttggattcgagaggaaaaatcattaaaggatctggagttttcaccccaaaactttaatcgttttgtcccttctttttttttcttgtctttcctccagcagctgcagactacataatgaaaaataacaaaagtgcccatgcgcgaggctgtgcaactaaccacccgacgattgcggggaggaggagtaagagtcggctaagcggcgcccagtgtcctactgcgcctgtgcgccggtggcgtgcgcagaggcctctgggtaggtggctcaaccccgcctctcagttgaggactctgaaggctgtttctgtggcgcttcccctgcgaggatggctaccctggttgtaaacaagctcggagcgggagtagacagtggccggcagggcagccgggggacagctgtagtgaaggtgctagagtgtggagtttgtgaagatgtcttttctttgcaaggagacaaagttccccgtcttttgctttgtggccataccgtctgtcatgactgtctcactcgcctacctcttcatggaagagcaatccgttgcccatttgatcgacaagtaacagacctaggtgattcaggtgtctggggattgaaaaaaaattttgctttattggagcttttggaacgactgcagaatgggcctattggtcagtatggagctgcagaagaatccattgggatatctggagagttctaccaagaataaagtgaaaagaggaagaagattatggaatagtaagaaagatatgtaagcaacagtagagaagaggatgcaaaagtagtcaacagtaaaactcaatgagagaaagaaaaactcgatagcatcattcgttgtgatgaagatgaagctcaccttgcctctgtatattgcactgtgtgtgcaactcatttgtgctctgagtgttctcaagttactcattctacaaagacattagcaaagcacaggcgagttcctctagctgataaacctcatgagaaaactatgtgctctcagcaccaggtgcatgccattgagtttgtttgcttggaagaaggttgtcaaactagcccactcatgtgctgtgtctgcaaagaatatggaaaacaccagggtcacaagcattcagtattggaaccagaagctaatcagatccgagcatcaattttagatatggctcactgcatacggaccttcacagaggaaatctcagattattccagaaaattagttggaattgtgcagcacattgaaggaggagaacaaatcgtggaagatggaattggaatggctcacacagaacatgtaccagggactgcagagaatgcccggtcatgtattcgagcttatttttatgatctacatgaaactctgtgtcgtcaagaagaaatggctctaagtgttgttgatgctcatgttcgtgaaaaattgatttggctcaggcagcaacaagaagatatgactattttgttgtcagaggtttctgcagcctgcctccactgtgaaaagactttgcagcaggatgattgtagagttgtcttggcaaaacaggaaattacaaggttactggaaacattgcagaaacagcagcagcagtttacagaagttgcagatcacattcagttggatgccagcatccctgtcacttttacaaaggataatcgagttcacattggaccaaaaatggaaattcgggtcgttacgttaggattggatggtgctggaaaaactactatcttgtttaagttaaaacaggatgaattcatgcagcccattccaacaattggttttaacgtggaaactgtagaatataaaaatctaaaattcactatttgggatgtaggtggaaaacacaaattaagaccattgtggaaacattattacctcaatactcaagctgttgtgtttgttgtagatagcagtcatagagacagaattagtgaagcacacagcgaacttgcaaagttgttaacggaaaaagaactccgagatgctctgctcctgatttttgctaacaaacaggatgttgctggagcactgtcagtagaagaaatcactgaactactcagtctccataaattatgctgtggccgtagctggtatattcagggctgtgatgctcgaagtggtatgggactgtatgaagggttggactggctctcacggcaacttgtagctgctggagtattggatgttgcttgattttaaaggcagcagttgtttgaagttttgtggttaaaagtaactttgcacatagtatgttttaagaaattatacatctcaaaagatggtaatttaggatgcatatatatatatatatatataaaggaatcttggattgggaattcagtactttgctttaaaaaaattttgtggcagaattaaatttctaattgagcagattagattgaattaaatagaaacttattgaatatacattcttttaaaaagtatatttgttatttaagtttttcagataatatgtgaccaatatactgggaaagaggtagtcacagagaaagggtaagtgaaggtttattctttcagtgaaaaaagaatagccaattgagtgcctaatgagacctctgtgtgaagcaagtgaagtatagctgcttcttttaacctgccttttcactgaatgttggcagcatttagtagtagaaatgacagttgcttaatgaaatagaatccaaactacatatttggataataggattactttatgtttatgttcagagttaacagaacacctttaatgctaagaactataaggtacagaaaattaatactttatatagtgttttattaactttctcctacagcattttgtataaaacacaatgagggagtgaaatgttacccaattaggcttgtcaggttagtaataaactgaacagtaataaaactgtggaagtaattggatctgaatttatgaaagacccatttccaggactgaacctaggtcagagctctaaattggtccttctatttttcaacaaatttaaagtaatatttctttctaatataatattgcatcctttgtgggaatgactataggtaaaatgtagtaagtaacgcagaaccagggttggctttatttaaaagctagtgacctaaatagaaagcgaacttcaagagaagttgtaagtacagtggcaaatgcttattacttacttcaaactgtttcccaaaataagtgcatttattttgacaataaaacttaaggctgttcatgagaaggccttgaaaagttactctagaggaaaaatgtctaaagaaaaaaaaaattcaaaaagtttacattaattattcagtgttgtgagtaaataaaaatgtgtgctctttactgtttttcatttttaaagaatattattatggaagcacgatttatttaaataggtacattgagacttttttttttaatgttctgatacattaggatgaagttaaatcttaaatcttattagttgaattgttgtaaggacagtgatgtctggtaacaagatgtgactttttggtagcactgttgtggttcattcttttcaaatctatttttgtttaaaaacaatacaagttttagaaaacaaagcattaaaaaaaaagcctatcagtattatgggcaatatgtaaataaataaatgtaatatttcatcctttatttttcaggtaaaaggtcatgctgttacaggtgtagtttgtgtgcataaataatacttccgaattaaattatttaatatttgactgatttcaataactgtgaaaaataaaaaaggtgttgtattgcttgtgagaacttgaactgtttactagttaattgaagaaaaagtgtaacactaaggtgaacttgcttcccttttcactaattttgctaaactttgtaatgcacattcttagcatataactgaacacagttgaaaaattgtgcctgattataatgtatgtataatggtaggtgtttgtgtgtgattcatttttaaagaaatatttttctcaagctcctattactatttgtggttgtattatttcactaatcattagttaagactgtgctagtcttccctgggaaactaagaagagagcttttttatatacagtatattagaattttcctagtagctgaatttctgtattaggtctaaatattactgtatgttatataaagcaggtatgtcaagtgtatagccgtagtctataattcaggaatgctttataaccatcagaagccattatttgcactacatatatgataagtatagacagcaataaaatgttaagatcattttt

SEQ ID NO: 454850 - DNA, 1640 bp, Homo sapiens
gttcacgccctggctggtttggattcgagaggaaaaatcattaaaggatctggagttttcaccccaaaactttaatcgttttgtcccttctttttttttcttgtctttcctccagcagctgcagactacataatgaaaaataacaaaagtgcccatgcgcgaggctgtgcaactaaccacccgacgattgcggggaggaggagtaagagtcggctaagcggcgcccagtgtcctactgcgcctgtgcgccggtggcgtgcgcagaggcctctgggtaggtggctcaaccccgcctctcagttgaggactctgaaggctgtttctgtggcgcttcccctgcgaggatggctaccctggttgtaaacaagctcggagcgggagtagacagtggccggcagggcagccgggggacagctgtagtgaaggtgctagagtgtggagtttgtgaagatgtcttttctttgcaaggagacaaagttccccgtcttttgctttgtggccataccgtctgtcatgactgtctcactcgcctacctcttcatggaagagcaatccgttgcccatttgatcgacaagtaacagacctaggtgattcaggtgtctggggattgaaaaaaaattttgctttattggagcttttggaacgactgcagaatgggcctattggtcagtatggagctgcagaagaatccattgggatatctggagagagcatcattcgttgtgatgaagatgaagctcaccttgcctctgtatattgcactgtgtgtgcaactcatttgtgctctgagtgttctcaagttactcattctacaaagacattagcaaagcacaggcgagttcctctagctgataaacctcatgagaaaactatgtgctctcagcaccaggtgcatgccattgagtttgtttgcttggaagaaggttgtcaaactagcccactcatgtgctgtgtctgcaaagaatatggaaaacaccagggtcacaagcattcagtattggaaccagaagctaatcagatccgagcatcaattttagatatggctcactgcatacggaccttcacagaggaaatctcagattattccagaaaattagttggaattgtgcagcacattgaaggaggagaacaaatcgtggaagatggaattggaatggctcacacagaacatgtaccagggactgcagagaatgcccggtcatgtattcgagcttatttttatgatctacatgaaactctgtgtcgtcaagaagaaatggctctaagtgttgttgatgctcatgttcgtgaaaaattgatttggctcaggcagcaacaagaagatatgactattttgttgtcagaggtttctgcagcctgcctccactgtgaaaagactttgcagcagttcccactacagagaaaattgaacagaggaatggatggaacatcacaaattgatcttcacttctgagaacataatttaatcatccatccactctaaacaaattatgcatcatctaaagttcttggcatgatactggatgctgaatatttattcatttagcaaatatgtattgagtagctaacatatgccatgtatttaaaatatatcagtgaacacaataagcaaaaagccataatcttgtgaaattagcat

SEQ ID NO: 454851 - DNA, 2668 bp, Homo sapiens
gttcacgccctggctggtttggattcgagaggaaaaatcattaaaggatctggagttttcaccccaaaactttaatcgttttgtcccttctttttttttcttgtctttcctccagcagctgcagactacataatgaaaaataacaaaagtgcccatgcgcgaggctgtgcaactaaccacccgacgattgcggggaggaggagtaagagtcggctaagcggcgcccagtgtcctactgcgcctgtgcgccggtggcgtgcgcagaggcctctgggtaggtggctcaaccccgcctctcagttgaggactctgaaggctgtttctgtggcgcttcccctgcgaggatggctaccctggttgtaaacaagctcggagcgggagtagacagtggccggcagggcagccgggggacagctgtagtgaaggtgctagagtgtggagtttgtgaagatgtcttttctttgcaaggagacaaagttccccgtcttttgctttgtggccataccgtctgtcatgactgtctcactcgcctacctcttcatggaagagcaatccgttgcccatttgatcgacaagtaacagacctaggtgattcaggtgtctggggattgaaaaaaaattttgctttattggagcttttggaacgactgcagaatgggcctattggtcagtatggagctgcagaagaatccattgggatatctggagagagcatcattcgttgtgatgaagatgaagctcaccttgcctctgtatattgcactgtgtgtgcaactcatttgtgctctgagtgttctcaagttactcattctacaaagacattagcaaagcacaggcgagttcctctagctgataaacctcatgagaaaactatgtgctctcagcaccaggtgcatgccattgagtttgtttgcttggaagaaggttgtcaaactagcccactcatgtgctgtgtctgcaaagaatatggaaaacaccagggtcacaagcattcagtattggaaccagaagctaatcagatccgagcatcaattttagatatggctcactgcatacggaccttcacagaggaaatctcagattattccagaaaattagttggaattgtgcagcacattgaaggaggagaacaaatcgtggaagatggaattggaatggctcacacagaacatgtaccagggactgcagagaatgcccggtcatgtattcgagcttatttttatgatctacatgaaactctgtgtcgtcaagaagaaatggctctaagtgttgttgatgctcatgttcgtgaaaaattgatttggctcaggcagcaacaagaagatatgactattttgttgtcagaggtttctgcagcctgcctccactgtgaaaagactttgcagcaggatgattgtagagttgtcttggcaaaacaggaaattacaaggttactggaaacattgcagaaacagcagcagcagtttacagaagttgcagatcacattcagttggatgccagcatccctgtcacttttacaaaggataatcgagttcacattggaccaaaaatggaaattcgggtcgttacgttaggattggatggtgctggaaaaactactatcttgtttaagttaaaacaggatgaattcatgcagcccattccaacaattggttttaacgtggaaactgtagaatataaaaatctaaaattcactatttgggatgtaggtggaaaacacaaattaagaccattgtggaaacattattacctcaatactcaagctgttgtgtttgttgtagatagcagtcatagagacagaattagtgaagcacacagcgaacttgcaaagttgttaacggaaaaagaactccgagatgctctgctcctgatttttgctaacaaacaggatgttgctggagcactgtcagtagaagaaatcactgaactactcagtctccataaattatgctgtggccgtagctggtatattcagggctgtgatgctcgaagtgtttttcagataatatgtgaccaatatactgggaaagaggtagtcacagagaaagggtaaaaggtcatgctgttacaggtgtagtttgtgtgcataaataatacttccgaattaaattatttaatatttgactgatttcaataactgtgaaaaataaaaaaggtgttgtattgcttgtgagaacttgaactgtttactagttaattgaagaaaaagtgtaacactaaggtgaacttgcttcccttttcactaattttgctaaactttgtaatgcacattcttagcatataactgaacacagttgaaaaattgtgcctgattataatgtatgtataatggtaggtgtttgtgtgtgattcatttttaaagaaatatttttctcaagctcctattactatttgtggttgtattatttcactaatcattagttaagactgtgctagtcttccctgggaaactaagaagagagcttttttatatacagtatattagaattttcctagtagctgaatttctgtattaggtctaaatattactgtatgttatataaagcaggtatgtcaagtgtatagccgtagtctataattcaggaatgctttataaccatcagaagccattatttgcactacatatatgataagtatagacagcaataaaatgttaagatcattttt

SEQ ID NO: 454852 - DNA, 3847 bp, Homo sapiens
gttcacgccctggctggtttggattcgagaggaaaaatcattaaaggatctggagttttcaccccaaaactttaatcgttttgtcccttctttttttttcttgtctttcctccagcagctgcagactacataatgaaaaataacaaaagtgcccatgcgcgaggctgtgcaactaaccacccgacgattgcggggaggaggagtaagagtcggctaagcggcgcccagtgtcctactgcgcctgtgcgccggtggcgtgcgcagaggcctctgggtaggtggctcaaccccgcctctcagttgaggactctgaaggctgtttctgtggcgcttcccctgcgaggatggctaccctggttgtaaacaagctcggagcgggagtagacagtggccggcagggcagccgggggacagctgtagtgaaggtgctagagtgtggagtttgtgaagatgtcttttctttgcaaggagacaaagttccccgtcttttgctttgtggccataccgtctgtcatgactgtctcactcgcctacctcttcatggaagagcaatccgttgcccatttgatcgacaagtaacagacctaggtgattcaggtgtctggggattgaaaaaaaattttgctttattggagcttttggaacgactgcagaatgggcctattggtcagtatggagctgcagaagaatccattgggatatctggagagagcatcattcgttgtgatgaagatgaagctcaccttgcctctgtatattgcactgtgtgtgcaactcatttgtgctctgagtgttctcaagttactcattctacaaagacattagcaaagcacaggcgagttcctctagctgataaacctcatgagaaaactatgtgctctcagcaccaggtgcatgccattgagtttgtttgcttggaagaaggttgtcaaactagcccactcatgtgctgtgtctgcaaagaatatggaaaacaccagggtcacaagcattcagtattggaaccagaagctaatcagatccgagcatcaattttagatatggctcactgcatacggaccttcacagaggaaatctcagattattccagaaaattagttggaattgtgcagcacattgaaggaggagaacaaatcgtggaagatggaattggaatggctcacacagaacatgtaccagggactgcagagaatgcccggtcatgtattcgagcttatttttatgatctacatgaaactctgtgtcgtcaagaagaaatggctctaagtgttgttgatgctcatgttcgtgaaaaattgatttggctcaggcagcaacaagaagatatgactattttgttgtcagaggtttctgcagcctgcctccactgtgaaaagactttgcagcaggatgattgtagagttgtcttggcaaaacaggaaattacaaggttactggaaacattgcagaaacagcagcagcagtttacagaagttgcagatcacattcagttggatgccagcatccctgtcacttttacaaaggataatcgagttcacattggaccaaaaatggaaattcgggtcgttacgttaggattggatggtgctggaaaaactactatcttgtttaagttaaaacaggatgaattcatgcagcccattccaacaattggttttaacgtggaaactgtagaatataaaaatctaaaattcactatttgggatgtaggtggaaaacacaaattaagaccattgtggaaacattattacctcaatactcaagctgttgtgtttgttgtagatagcagtcatagagacagaattagtgaagcacacagcgaacttgcaaagttgttaacggaaaaagaactccgagatgctctgctcctgatttttgctaacaaacaggatgttgctggagcactgtcagtagaagaaatcactgaactactcagtctccataaattatgctgtggccgtagctggtatattcagggctgtgatgctcgaagtggtatgggactgtatgaagggttggactggctctcacggcaacttgtagctgctggagtattggatgttgcttgattttaaaggcagcagttgtttgaagttttgtggttaaaagtaactttgcacatagtatgttttaagaaattatacatctcaaaagatggtaatttaggatgcatatatatatatatatatataaaggaatcttggattgggaattcagtactttgctttaaaaaaattttgtggcagaattaaatttctaattgagcagattagattgaattaaatagaaacttattgaatatacattcttttaaaaagtatatttgttatttaagtttttcagataatatgtgaccaatatactgggaaagaggtagtcacagagaaagggtaagtgaaggtttattctttcagtgaaaaaagaatagccaattgagtgcctaatgagacctctgtgtgaagcaagtgaagtatagctgcttcttttaacctgccttttcactgaatgttggcagcatttagtagtagaaatgacagttgcttaatgaaatagaatccaaactacatatttggataataggattactttatgtttatgttcagagttaacagaacacctttaatgctaagaactataaggtacagaaaattaatactttatatagtgttttattaactttctcctacagcattttgtataaaacacaatgagggagtgaaatgttacccaattaggcttgtcaggttagtaataaactgaacagtaataaaactgtggaagtaattggatctgaatttatgaaagacccatttccaggactgaacctaggtcagagctctaaattggtccttctatttttcaacaaatttaaagtaatatttctttctaatataatattgcatcctttgtgggaatgactataggtaaaatgtagtaagtaacgcagaaccagggttggctttatttaaaagctagtgacctaaatagaaagcgaacttcaagagaagttgtaagtacagtggcaaatgcttattacttacttcaaactgtttcccaaaataagtgcatttattttgacaataaaacttaaggctgttcatgagaaggccttgaaaagttactctagaggaaaaatgtctaaagaaaaaaaaaattcaaaaagtttacattaattattcagtgttgtgagtaaataaaaatgtgtgctctttactgtttttcatttttaaagaatattattatggaagcacgatttatttaaataggtacattgagacttttttttttaatgttctgatacattaggatgaagttaaatcttaaatcttattagttgaattgttgtaaggacagtgatgtctggtaacaagatgtgactttttggtagcactgttgtggttcattcttttcaaatctatttttgtttaaaaacaatacaagttttagaaaacaaagcattaaaaaaaaagcctatcagtattatgggcaatatgtaaataaataaatgtaatatttcatcctttatttttcaggtaaaaggtcatgctgttacaggtgtagtttgtgtgcataaataatacttccgaattaaattatttaatatttgactgatttcaataactgtgaaaaataaaaaaggtgttgtattgcttgtgagaacttgaactgtttactagttaattgaagaaaaagtgtaacactaaggtgaacttgcttcccttttcactaattttgctaaacttttgttaattgcaccatttctttaggcattattaaaacttgaaccaccaaatttgtgttggtattggttggtggtggaatttccttttttttgggttattttttt

SEQ ID NO: 454853 - DNA, 4097 bp, Homo sapiens
gttcacgccctggctggtttggattcgagaggaaaaatcattaaaggatctggagttttcaccccaaaactttaatcgttttgtcccttctttttttttcttgtctttcctccagcagctgcagactacataatgaaaaataacaaaagtgcccatgcgcgaggctgtgcaactaaccacccgacgattgcggggaggaggagtaagagtcggctaagcggcgcccagtgtcctactgcgcctgtgcgccggtggcgtgcgcagaggcctctgggtaggtggctcaaccccgcctctcagttgaggactctgaaggctgtttctgtggcgcttcccctgcgaggatggctaccctggttgtaaacaagctcggagcgggagtagacagtggccggcagggcagccgggggacagctgtagtgaaggtgctagagtgtggagtttgtgaagatgtcttttctttgcaaggagacaaagttccccgtcttttgctttgtggccataccgtctgtcatgactgtctcactcgcctacctcttcatggaagagcaatccgttgcccatttgatcgacaagtaacagacctaggtgattcaggtgtctggggattgaaaaaaaattttgctttattggagcttttggaacgactgcagaatgggcctattggtcagtatggagctgcagaagaatccattgggatatctggagagagcatcattcgttgtgatgaagatgaagctcaccttgcctctgtatattgcactgtgtgtgcaactcatttgtgctctgagtgttctcaagttactcattctacaaagacattagcaaagcacaggcgagttcctctagctgataaacctcatgagaaaactatgtgctctcagcaccaggtgcatgccattgagtttgtttgcttggaagaaggttgtcaaactagcccactcatgtgctgtgtctgcaaagaatatggaaaacaccagggtcacaagcattcagtattggaaccagaagctaatcagatccgagcatcaattttagatatggctcactgcatacggaccttcacagaggaaatctcagattattccagaaaattagttggaattgtgcagcacattgaaggaggagaacaaatcgtggaagatggaattggaatggctcacacagaacatgtaccagggactgcagagaatgcccggtcatgtattcgagcttatttttatgatctacatgaaactctgtgtcgtcaagaagaaatggctctaagtgttgttgatgctcatgttcgtgaaaaattgatttggctcaggcagcaacaagaagatatgactattttgttgtcagaggtttctgcagcctgcctccactgtgaaaagactttgcagcaggatgattgtagagttgtcttggcaaaacaggaaattacaaggttactggaaacattgcagaaacagcagcagcagtttacagaagttgcagatcacattcagttggatgccagcatccctgtcacttttacaaaggataatcgagttcacattggaccaaaaatggaaattcgggtcgttacgttaggattggatggtgctggaaaaactactatcttgtttaagttaaaacaggatgaattcatgcagcccattccaacaattggttttaacgtggaaactgtagaatataaaaatctaaaattcactatttgggatgtaggtggaaaacacaaattaagaccattgtggaaacattattacctcaatactcaagctgttgtgtttgttgtagatagcagtcatagagacagaattagtgaagcacacagcgaacttgcaaagttgttaacggaaaaagaactccgagatgctctgctcctgatttttgctaacaaacaggatgttgctggagcactgtcagtagaagaaatcactgaactactcagtctccataaattatgctgtggccgtagctggtatattcagggctgtgatgctcgaagtggtatgggactgtatgaagggttggactggctctcacggcaacttgtagctgctggagtattggatgttgcttgattttaaaggcagcagttgtttgaagttttgtggttaaaagtaactttgcacatagtatgttttaagaaattatacatctcaaaagatggtaatttaggatgcatatatatatatatatatataaaggaatcttggattgggaattcagtactttgctttaaaaaaattttgtggcagaattaaatttctaattgagcagattagattgaattaaatagaaacttattgaatatacattcttttaaaaagtatatttgttatttaagtttttcagataatatgtgaccaatatactgggaaagaggtagtcacagagaaagggtaagtgaaggtttattctttcagtgaaaaaagaatagccaattgagtgcctaatgagacctctgtgtgaagcaagtgaagtatagctgcttcttttaacctgccttttcactgaatgttggcagcatttagtagtagaaatgacagttgcttaatgaaatagaatccaaactacatatttggataataggattactttatgtttatgttcagagttaacagaacacctttaatgctaagaactataaggtacagaaaattaatactttatatagtgttttattaactttctcctacagcattttgtataaaacacaatgagggagtgaaatgttacccaattaggcttgtcaggttagtaataaactgaacagtaataaaactgtggaagtaattggatctgaatttatgaaagacccatttccaggactgaacctaggtcagagctctaaattggtccttctatttttcaacaaatttaaagtaatatttctttctaatataatattgcatcctttgtgggaatgactataggtaaaatgtagtaagtaacgcagaaccagggttggctttatttaaaagctagtgacctaaatagaaagcgaacttcaagagaagttgtaagtacagtggacaataaaacttaaggctgttcatgagaaggccttgaaaagttactctagaggaaaaatgtctaaagaaaaaaaaaattcaaaaagtttacattaattattcagtgttgtgagtaaataaaaatgtgtgctctttactgtttttcatttttaaagaatattattatggaagcacgatttatttaaataggtacattgagacttttttttttaatgttctgatacattaggatgaagttaaatcttaaatcttattagttgaattgttgtaaggacagtgatgtctggtaacaagatgtgactttttggtagcactgttgtggttcattcttttcaaatctatttttgtttaaaaacaatacaagttttagaaaacaaagcattaaaaaaaaagcctatcagtattatgggcaatatgtaaataaataaatgtaatatttcatcctttatttttcaggtaaaaggtcatgctgttacaggtgtagtttgtgtgcataaataatacttccgaattaaattatttaatatttgactgatttcaataactgtgaaaaataaaaaaggtgttgtattgcttgtgagaacttgaactgtttactagttaattgaagaaaaagtgtaacactaaggtgaacttgcttcccttttcactaattttgctaaactttgtaatgcacattcttagcatataactgaacacagttgaaaaattgtgcctgattataatgtatgtataatggtaggtgtttgtgtgtgattcatttttaaagaaatatttttctcaagctcctattactatttgtggttgtattatttcactaatcattagttaagactgtgctagtcttccctgggaaactaagaagagagcttttttatatacagtatattagaattttcctagtagctgaatttctgtattaggtctaaatattactgtatgttatataaagcaggtatgtcaagtgtatagccgtagtctataattcaggaatgctttataaccatcagaagccattatttgcactacatatatgataagtatagacagcaataaaatgttaagatcattttt

SEQ ID NO: 454854 - DNA, 1027 bp, Homo sapiens
  misc_feature (2)..(3): n is a, c, g, or t
gnnggagtgggggagagagaggagaccaggacagctgctgagacctctaagaagtccagatactaagagcaaagatgtttcaaactgggggcctcattgtcttctacgggctgttagcccagaccatggcccagtttggaggcctgcccgtgcccctggaccagaccctgcccttgaatgtgaatccagccctgcccttgagtcccacaggtcttgcaggaagcttgacaaatgccctcagcaatggcctgctgtctgggggcctgttgggcattctggaaaaccttccgctcctggacatcctgaagcctggaggaggtacttctggtggcctccttgggggactgcttggaaaagtgacgtcagtgattcctggcctgaacaacatcattgacataaaggtcactgacccccagctgctggaacttggccttgtgcagagccctgatggccaccgtctctatgtcaccatccctctcggcataaagctccaagtgaatacgcccctggtcggtgcaagtctgttgaggctggctgtgaagctggacatcactgcagaaatcttagctgtgagagataagcaggagaggatccacctggtccttggtgactgcacccattcccctggaagcctgcaaatttctctgcttgatggacttggccccctccccattcaaggtcttctggacagcctcacagggatcttgaataaagtcctgcctgagttggttcagggcaacgtgtgccctctggtcaatgaggttctcagaggcttggacatcaccctggtgcatgacattgttaacatgctgatccacggactacagtttgtcatcaaggtctaagccttccaggaaggggctggcctctgctgagctgcttcccagtgctcacagatggctggcccatgtgctggaagatgacacagttgccttctctccgaggaacctgccccctctcctttcccaccaggcgtgtgtaacatcccatgtgcctcacctaataaaatggctcttcttctgcatca

SEQ ID NO: 454855 - DNA, 806 bp, Homo sapiens
agctctgtgagctccttgtgtcaaggatagcttttagagaaattcctagaattcacttcacctcctgcctttctgccttgatggtgttttgttctctggaacttttggtcttttccctgtatgggtcatggtgtaagggagattccttgttagaagagaagcagaagctcatcaggccagagcacaggaggatgaacctagcagccccatgtggcaggcactgtgtgccattcctattatgggaccattgggaaggaataaagggctccagagtgggtcttgcccctggtcggtgcaagtctgttgaggctggctgtgaagctggacatcactgcagaaatcttagctgtgagagataagcaggagaggatccacctggtccttggtgactgcacccattcccctggaagcctgcaaatttctctgcttgatggacttggccccctccccattcaaggtcttctggacagcctcacagggatcttgaataaagtcctgcctgagttggttcagggcaacgtgtgccctctggtcaatgaggttctcagaggcttggacatcaccctggtgcatgacattgttaacatgctgatccacggactacagtttgtcatcaaggtctaagccttccaggaaggggctggcctctgctgagctgcttcccagtgctcacagatggctggcccatgtgctggaagatgacacagttgccttctctccgaggaacctgccccctctcctttcccaccaggcgtgtgtaacatcccatgtgcctcacctaataaaatggctcttcttctgcatca

SEQ ID NO: 454856 - DNA, 483 bp, Homo sapiens
ccagcacactcacacacatgcacacattggtggactcaccacacacagacacacacactctcacccagcaccctcacacatatgcacacatcagtggactcaccacacataagtacacgtggatacacagacacactcactcaaacacatgctcacagagccctgactccaggcctgatggcttgcccagggtctcagcctcctcctgtccctctggggcatgagtttgatgatgagtcaatatcagtaacgctcactgaccttgagtctccatcctgattagggtcttcccccaacagaactatttcttgctgctcaatccatttcctctggcccagcttcccagtgctcacagatggctggcccatgtgctggaagatgacacagttgccttctctccgaggaacctgccccctctcctttcccaccaggcgtgtgtaacatcccatgtgcctcacctaataaaatggctcttcttctgca

SEQ ID NO: 454857 - DNA, 1074 bp, Homo sapiens
  misc_feature (2)..(3): n is a, c, g, or t
gnnggagtgggggagagagaggagaccaggacagctgctgagacctctaagaagtccagatactaagagcaaagatgtttcaaactgggggcctcattgtcttctacgggctgttagcccagaccatggcccagtttggaggcctgcccgtgcccctggaccagaccctgcccttgaatgtgaatccagccctgcccttgagtcccacaggtcttgcaggaagcttgacaaatgccctcagcaatggcctgctgtctgggggcctgttgggcattctggaaaaccttccgctcctggacatcctgaagcctggaggaggtacttctggtggcctccttgggggactgcttggaaaagtgacgtcagtgattcctggcctgaacaacatcattgacataaaggtcactgacccccagctgctggaacttggccttgtgcagagccctgatggccaccgtctctatgtcaccatccctctcggcataaagctccaagtgaatacgcccctggtcggtgcaagtctgttgaggctggctgtgaagctggacatcactgcagaaatcttagctgtgagagataagcaggagaggatccacctggtccttggtgactgcacccattcccctggaagcctgcaaatttctctgcttgatggacttggccccctccccattcaaggtcttctggacagcctcacagggatcttgaataaagtcctgcctgagttggttcagggcaacgtgtgccctctggtcaatgaggttctcagaggcttggacatcaccctggtgcatgacattgttaacatgctgatccacggactacagtttgtcatcaaggtctaagccttccaggaaggggctggcctctgctgagctgcccaacagaactatttcttgctgctcaatccatttcctctggcccagcttcccagtgctcacagatggctggcccatgtgctggaagatgacacagttgccttctctccgaggaacctgccccctctcctttcccaccaggcgtgtgtaacatcccatgtgcctcacctaataaaatggctcttcttctgcatca

SEQ ID NO: 454858 - DNA, 1221 bp, Homo sapiens
cctggcagccctgccacccccgccttcggctcccattggctgccacggcctgcagtgggctgcaccagggttcatccatcctccctgggcagagggaataagaggctgcctctgcccaccagtcctgccgcccaggacccgcagcagagacgacgcctgcagcaaggagaccaggaaggggtgagacaaggaagaggatgtctgagctggagaaggccatggtggccctcatcgacgttttccaccaatattctggaagggagggagacaagcacaagctgaagaaatccgaactcaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctatattaggcctgtgtgtaagctgactggccccagggactcttgttaacagtaacttaggagtcaggtctcagtgataaagcgtgcaccgtgcagcccgccatggccgtgtagaccctaacccggagggaaccctgactacagaaattaccccggggcacccttaaaacttccactacctttaaaaaacaaagccttatccagcattatttgaaaacactgctgttctttaaatgcgttcctcatccatgcagataacagctggttggccggtgtggccctgcaagggcgtggtggcttcggcctgcttcccgggatgcgcctgatcaccaggtgaacgctcagcgctggcagcgctcctggaaaaagcaactccatcagaactcgcaatccgagccagctctgggggctccagcgtggcctccgtgacccatgcgattcaagtcgcggctgcaggatccttgcctccaacgtgcctccagcacatgcggcttccgagggcactaccgggggctctgagccaccgcgagggcctgcgttcaataaaaag

SEQ ID NO: 454859 - DNA, 677 bp, Homo sapiens
gccagcgtgagagggaacatgtgggaactggcccctgcccttgattcctctgcctcaaagttgggatctgaaagccatgtagggctagaagaccctgaggctgttctcccttctgttcatagtgagactcaaaaagccaagtcccagaagttctgaagggctgtgactagaagtgcccaggtccttcagggagctttaagaatgaccccacagaactcaagtttaactaggggttaggtcccagattcagacccaggagtttataaaaatgagctctacttccagttttggtttaaacaggtgtgagccaccgtgcctgacccctgtgtgtcttatagccaaggcagctgttgtacattacacttgacttcttcaggccaagccttcctatcccggagaattgttactctgcatttatgctcttcatcagtgttcaatacccaaatttttcccaccaaaaaaaaaaaaaaaaaaaaaccttcggagggcatctatgccggggggcgggaaaaaaggggtattcgaattgggcccatggggccataaggctggttcccttgagaccacaggttttctttgtaccaaagggggtaaaactctggccgggtctcccctataataggggaggcggtataaatctcagaaaacgccgggtaacccttgttatgaccggaaac

SEQ ID NO: 454860 - DNA, 1223 bp, Homo sapiens
  misc_feature (890)..(890): n is a, c, g, or t
  misc_feature (937)..(937): n is a, c, g, or t
  misc_feature (962)..(962): n is a, c, g, or t
  misc_feature (984)..(984): n is a, c, g, or t
  misc_feature (993)..(993): n is a, c, g, or t
cctggcagccctgccacccccgccttcggctcccattggctgccacggcctgcagtgggctgcaccagggttcatccatcctccctgggcagagggaataagaggctgcctctgcccaccagtcctgccgcccaggacccgcagcagagacgacgcctgcagcaaggagaccaggaaggggtgagacaaggaagaggatgtctgagctggagaaggccatggtggccctcatcgacgttttccaccaatattctggaagggagggagacaagcacaagctgaagaaatccgaactcaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctatattaggcctgtgtgtaagctgactggccccagggactcttgttaacagtaacttaggagtcaggtctcagtgataaagcgtgcaccgtgcagcccgccatggccgtgtagaccctaacccggagggaaccctgactacagaaattaccccggggcacccttaaaacttccactacctttaaaaaacaaagccttatccagcaaaaaaaaaaaaanaaaaaaaaaaaaaaaaaaaaaaaaaaaaaaaaaaaaaaaaaaaaaanaaaaaaaaaaaaaaaaaaaaaaaanaaaaaaaaaaaaaaaaaaaaanaaaaaaaanaaaaaaaaaaaaaaaaaagagaagacggggccggcccaatgaatagcagccccagccggacgcgacgacacgagggcacccaccacccgccctttgctgtcgacacggccgcgcgcctccaagacgacgcgccaacgacacaaagaacggcgagcagcgcacccctacaacacagaccgcggacaggacaagagcgacgcaccacgaggggacgggacacaaatcctggc

SEQ ID NO: 454861 - DNA, 1315 bp, Homo sapiens
cctggcagccctgccacccccgccttcggctcccattggctgccacggcctgcagtgggctgcaccagggttcatccatcctccctgggcagagggaataagaggctgcctctgcccaccagtcctgccgcccaggacccgcagcagagacgacgcctgcagcaaggagaccaggaaggggtgagacaaggaagaggatgtctgagctggagaaggccatggtggccctcatcgacgttttccaccaatattctggaagggagggagacaagcacaagctgaagaaatccgaactcaaggagctcatcaacaatgagctttcccatttcttagagagatggagtctccctatgttgcccaggctggtctcaaacttcctgtgctcaagttatcctcctgccttagcttcccaaagtgctgggattacaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctatattaggcctgtgtgtaagctgactggccccagggactcttgttaacagtaacttaggagtcaggtctcagtgataaagcgtgcaccgtgcagcccgccatggccgtgtagaccctaacccggagggaaccctgactacagaaattaccccggggcacccttaaaacttccactacctttaaaaaacaaagccttatccagcattatttgaaaacactgctgttctttaaatgcgttcctcatccatgcagataacagctggttggccggtgtggccctgcaagggcgtggtggcttcggcctgcttcccgggatgcgcctgatcaccaggtgaacgctcagcgctggcagcgctcctggaaaaagcaactccatcagaactcgcaatccgagccagctctgggggctccagcgtggcctccgtgacccatgcgattcaagtcgcggctgcaggatccttgcctccaacgtgcctccagcacatgcggcttccgagggcactaccgggggctctgagccaccgcgagggcctgcgttcaataaaaag

SEQ ID NO: 454862 - DNA, 987 bp, Homo sapiens
  misc_feature (654)..(654): n is a, c, g, or t
  misc_feature (701)..(701): n is a, c, g, or t
  misc_feature (726)..(726): n is a, c, g, or t
  misc_feature (748)..(748): n is a, c, g, or t
  misc_feature (757)..(757): n is a, c, g, or t
cggacacaaattatcagagtcactcaacttttaatcatgttttgatggtccaaaattccatttaaaaacaaggtcggcaactccttttatctctcttaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctatattaggcctgtgtgtaagctgactggccccagggactcttgttaacagtaacttaggagtcaggtctcagtgataaagcgtgcaccgtgcagcccgccatggccgtgtagaccctaacccggagggaaccctgactacagaaattaccccggggcacccttaaaacttccactacctttaaaaaacaaagccttatccagcaaaaaaaaaaaaanaaaaaaaaaaaaaaaaaaaaaaaaaaaaaaaaaaaaaaaaaaaaaanaaaaaaaaaaaaaaaaaaaaaaaanaaaaaaaaaaaaaaaaaaaaanaaaaaaaanaaaaaaaaaaaaaaaaaagagaagacggggccggcccaatgaatagcagccccagccggacgcgacgacacgagggcacccaccacccgccctttgctgtcgacacggccgcgcgcctccaagacgacgcgccaacgacacaaagaacggcgagcagcgcacccctacaacacagaccgcggacaggacaagagcgacgcaccacgaggggacgggacacaaatcctggc

SEQ ID NO: 454863 - DNA, 807 bp, Homo sapiens
gcacgagatggcaacaaaggccatgaattcctggaagtcacgagttctttgaacatgagtgagattagaaagcagccaaacctttcctgtaacagagacggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctatattaggcctgtgtgtaagctgactggccccagggactcttgttaacagtaacttaggagtcaggtctcagtgataaagcgtgcaccgtgcagcccgccatggccgtgtagaccctaacccggagggaaccctgactacagaaattaccccggggcacccttaaaacttccactacctttaaaaaacaaagccttatccagcattatttgaaaacactgctgttctttaaatgcgttcctcatccatgcagataacagctggttggccggtgtggccctgcaagggcgtggtggcttcggcctgcttcccgggatgcgcctgatcaccaggtgaacgctcagcgctggcagcgctcctggaaaaagcaactccatcagaactcgcaatccgagccagctctgggggctccagcgtggcctccgtgacccatgcgattcaagtcgcggctgcaggatccttgcctccaacgtgcctccagcacatgcggcttccgagggcactaccgggggctctgagccaccgcgagggcctgcgttcaataaaaag

SEQ ID NO: 454864 - DNA, 1167 bp, Homo sapiens
cctggcagccctgccacccccgccttcggctcccattggctgccacggcctgcagtgggctgcaccagggttcatccatcctccctgggcagagggaataagaggctgcctctgcccaccagtcctgccgcccaggacccgcagcagagacgacgcctgcagcaaggagaccaggaaggggtgagacaaggaagaggatgtctgagctggagaaggccatggtggccctcatcgacgttttccaccaatattctggaagggagggagacaagcacaagctgaagaaatccgaactcaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggcttgcagcctagtaggagctgagctttccagccgtgttgtagctaattaggaagcttgatttgctttgtgattgaaaaattgtaggcctgtgtgtaagctgactggccccagggactcttgttaacagtaacttaggagtcaggtctcagtgataaagcgtgcaccgtgcagcccgccatggccgtgtagaccctaacccggagggaaccctgactacagaaattaccccggggcacccttaaaacttccactacctttaaaaaacaaagccttatccagcattatttgaaaacactgctgttctttaaatgcgttcctcatccatgcagataacagctggttggccggtgtggccctgcaagggcgtggtggcttcggcctgcttcccgggatgcgcctgatcaccaggtgaacgctcagcgctggcagcgctcctggaaaaagcaactccatcagaactcgcaatccgagccagctctgggggctccagcgtggcctccgtgacccatgcgattcaagtcgcggctgcaggatccttgcctccaacgtgcctccagcacatgcggcttccgagggcactaccgggggctctgagccaccgcgagggcctgcgttcaataaaaag

SEQ ID NO: 454865 - DNA, 991 bp, Homo sapiens
atgcaaagttaaaaaaaagaaggaaggaagagaggttccatttgagattctcacaacctcttgttcgacagctcgtgcagattcgggcagaaggcaaagccaagttaaagaatcgaatctcagggagcttatcaacaatgagctttcccatgtctagaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggcttgcagcctagtaggagctgagctttccagccgtgttgtagctaattaggaaaacggcctgcatcattctttctgctatattaggcctgtgtgtaagctgactggccccagggactcttgttaacagtaacttaggagtcaggtctcagtgataaagcgtgcaccgtgcagcccgccatggccgtgtagaccctaacccggagggaaccctgactacagaaattaccccggggcacccttaaaacttccactacctttaaaaaacaaagccttatccagcattatttgaaaacactgctgttctttaaatgcgttcctcatccatgcagataacagctggttggccggtgtggccctgcaagggcgtggtggcttcggcctgcttcccgggatgcgcctgatcaccaggtgaacgctcagcgctggcagcgctcctggaaaaagcaactccatcagaactcgcaatccgagccagctctgggggctccagcgtggcctccgtgacccatgcgattcaagtcgcggctgcaggatccttgcctccaacgtgcctccagcacatgcggcttccgagggcactaccgggggctctgagccaccgcgagggcctgcgttcaataaaaag

SEQ ID NO: 454866 - DNA, 880 bp, Homo sapiens
gccgcccaggacccgcagcagagacgacgcctgcagcaaggagaccaggaaggggtgagacaaggaagaggaggtgagaaagagccaggccaagaggacgctcaggaagaaatggttcttttcttttgggtggaacggaatggaggggtagaaactaagtggtagcttaaaaagcccctttaggacaattggcagcatttcagaagtgtcaataggatgatgtgttttaatctccacattactgctgctttgtggacacctgactgcatcagccctagacagctagaggtgtgttttgccataaatcagagaaacgtcaggtttcatggcccagaagtgattgttgacattttcccagcggtactacaaatactgcctcttctgtaactatttgaagagtaaagattttgcttcccactggggctaaaaatgatggagaacctaatgctagtttagtcctatatcataaataaatgcttcccttttctccttatatttcttccaccgccctgggtaagtaactcttcagttttccagtttccctcagtttgaagtgccagggtccccacagccccaggacgccactcagaaattacgtaacaattacaaataaattgggtcaaagaaatcggggttttggtgggttttaactttcctcagtctcacagtttctcagggaggtcgaaccccttctttagagggatcctcacacgctaggtaacttgtctttctaaggagttaaagttcaaaagttctcttgttctcaatattaaaagattaatgtaggacattcaaagaatgtgagaaagaaacggacatttatttccatttctcttaaaagataaactataaaccatcaactatttcttaggtcaaaggg

SEQ ID NO: 454867 - DNA, 1062 bp, Homo sapiens
  misc_feature (890)..(890): n is a, c, g, or t
cctggcagccctgccacccccgccttcggctcccattggctgccacggcctgcagtgggctgcaccagggttcatccatcctccctgggcagagggaataagaggctgcctctgcccaccagtcctgccgcccaggacccgcagcagagacgacgcctgcagcaaggagaccaggaaggggtgagacaaggaagaggatgtctgagctggagaaggccatggtggccctcatcgacgttttccaccaatattctggaagggagggagacaagcacaagctgaagaaatccgaactcaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctatattaggcctgtgtgtaagctgactggccccagggactcttgttaacagtaacttaggagtcaggtctcagtgataaagcgtgcaccgtgcagcccgccatggccgtgtagaccctaacccggagggaaccctgactacagaaattaccccggggcacccttaaaacttccactacctttaaaaaacaaagccttatccagcaaaaaaaaaaaaanaaaaaaaaaaaaaaaaacccggggggatattagtgggggggggggaaaaaggggatcagaatgggccccagggccaaagcgggtccgggaccagggttctcgggcaacaaggggacaaatgcgggggccccaaaaagggagccgcaaaaatcgcgaaacgcccgttaccgga

SEQ ID NO: 454868 - DNA, 1193 bp, Homo sapiens
  misc_feature (907)..(907): n is a, c, g, or t
  misc_feature (932)..(932): n is a, c, g, or t
  misc_feature (954)..(954): n is a, c, g, or t
  misc_feature (963)..(963): n is a, c, g, or t
cctggcagccctgccacccccgccttcggctcccattggctgccacggcctgcagtgggctgcaccagggttcatccatcctccctgggcagagggaataagaggctgcctctgcccaccagtcctgccgcccaggacccgcagcagagacgacgcctgcagcaaggagaccaggaaggggtgagacaaggaagaggatgtctgagctggagaaggccatggtggccctcatcgacgttttccaccaatattctggaagggagggagacaagcacaagctgaagaaatccgaactcaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctatattaggcctgtgtgtaagctgactggccccagggactcttgttaacagtaacttaggagtcaggtctcagtgataaagcgtgcaccgtgcagcccgccatggccgtgtagaccctaacccggagggaaccctgactacagaaattaccccggggcacccttaaaacttccactacctttaaaaaacaaagccttatccagcaaaaaaaaaaaaaaaaaaaaaaaaaaaaaanaaaaaaaaaaaaaaaaaaaaaaaanaaaaaaaaaaaaaaaaaaaaanaaaaaaaanaaaaaaaaaaaaaaaaaagagaagacggggccggcccaatgaatagcagccccagccggacgcgacgacacgagggcacccaccacccgccctttgctgtcgacacggccgcgcgcctccaagacgacgcgccaacgacacaaagaacggcgagcagcgcacccctacaacacagaccgcggacaggacaagagcgacgcaccacgaggggacgggacacaaatcctggc

SEQ ID NO: 454869 - DNA, 931 bp, Homo sapiens
cctggcagccctgccacccccgccttcggctcccattggctgccacggcctgcagtgggctgcaccagggttcatccatcctccctgggcagagggaataagaggctgcctctgcccaccagtcctgccgcccaggacccgcagcagagacgacgcctgcagcaaggagaccaggaaggggtgagacaaggaagaggatgtctgagctggagaaggccatggtggccctcatcgacgttttccaccaatattctggaagggagggagacaagcacaagctgaagaaatccgaactcaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctatattaggcctgtgtgtaagctgactggccccagggactcttgttaacagtaacttaggagtcaggtctcagtgataaagcgtgcaccgtgcagcccgccatggccgtgtagaccctaacccggagggaaccctgactacagaaattaccccggggcacccttaactcactacttaaaaacaacctttcagcaaaaaaaaaaacccggcctttgcgggaaaggttaggccggctagtccgccctgtagggatcgcctg

SEQ ID NO: 454870 - DNA, 618 bp, Homo sapiens
acagggcgtcgccttctcccctcagcacagaggagaggtgacgaatgccacttggtctctgcagcgtctgtagagggaagtctgtaagcgggagtgtcaaccccaattggcagattctctgacacttcaagtctgcaaaggaaaagcaggtacgactcctttatcttggacagtcatcttgtaatgcaggcctgtgggatacaaaggagaccagggaggttatgtgagctctgccaaatctattactactccaggggaaaataaaaccaaattcttgggctagtggaattactgtaggagaaatccagtatgattccatgtgaagaaccaatagcacccttaaattaaagccagatctgccagtgagcctcaggctttaggaactgaagaggtcataaaattgctgttatgtatgtgaaaacggccaaatataccatagaccccagattaggatcagtctggtgcctctgaaaatgtgaattgagaagaactgaaagaaaatctttccctggggagactgcagccgaaacacccttctgacgaatgtgctgacctaatctaagcctcaatttccttcaacaagggatgcatcgctcacttcccttgagttgtgagaat

SEQ ID NO: 454871 - DNA, 435 bp, Homo sapiens
tttatctacttttgcagaagatattgaaattgcaatcatcttgtttttgggggaatggagtcattccatattggctcttgagtatgtctgccaccactctgattctagctggaggctgccagaaatgactgtgccattgaatggagttattaggcaacataaaacggacaagccagaccaagtgtttctgaaagatctatccagcactccgatggccagcaacaacaccgccagcatagcacaagccaggaagctggtagagcagcttaagatggaagccaatatcgacaggataaaggaagttcactgacccctggtctacagcgatggttctcagctcatctgtgcgttcccaacacccagagagctctataaaaggaccaattaccgaaccacacccaaaccaattaaattagaatctcctggggtatgatt

SEQ ID NO: 454872 - DNA, 3652 bp, Homo sapiens
aatggaaatgagagggaaaagaagcaagccgctaacagctaccaagaagaggaggaagtgggagatgcgctgcttcctgtagaaagaacgttgattgaagacaaagctgggtggggactagtccctgggctgcagccgctgctacacatactcacaacgctgccgccgcgctccgtgggcaactcctactactgctgggctgggctgggctgggctgggctgcgccggagctcgcctgcacagatcagctccggagaggggaaaaccacgctcctcggaccaagcctcgggagctaagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagcccccccccccaaaatcctcatgtttctgcttcatattttgaaaaataacaattaaaacagacagctgtactgaggtaagatatgtgtgaccttcttggaatgaatattgtctttagaataccctttgataagctgagctgtcccgtgtagatgcaattcggtttaatggcattgatgtatagtcactgtgcctttctttttctttcttccttctcctctacccctccttccacccctccccattagagtagtgtggagataaggctggactggtctatcagattgaactccaagaatgatcacacaaaatgtttagggagatgttccccgtggtgtatcctcatggtaacaacgacaaaaaatgccggttgtctttgttctcttttcactattcctaacatgtgtacatgatagctttgattctgcaagtaaaagtaaatcctgtgttgtgactggtgctttcatatatttgtgacaatttttgagtaatattgcatgaaaatgtccctatgttacatccattcagaagttttgttgttttactctaaagctgggaaaggaaatgagagggaaaagaccccggagagggaagaaaatctcagtattttgaaaattgagattacttcagagccttagccacacctaaaatacctcctagttaatagtggtataaatgcctcttcaatacgttttccagaatccaaagcattttggtttatccaggacccagggcagcacagctgtcaccaagcaggagagttaaggattcaccatgagctgggaaatgcttttgccatgagtatgagcaaattccctctttccctgaatcatggacattctagattaaaagaacatttttttgtgctcttaacaagaaaaccatggccctcctttgttcaagtatcagaagaaataaacccacagctccagagaaggtgaccattctcagaactccagctattcactctccagggagaaggacctcaaatcgccactctttgggcggcaggtgcggtccccacggccggctctacgaggaagagttctggctcttttgtccactgagatggtcttggtttttcacttaacaaattttttaatggaatctttgtttttgttctccatcttgtttgttagagtctctcggcctttatttacaaattccttgcaactagagcgctccttccccaagatatggtagtgagagtaatttttcattgtagctgtagtctccatcagtaacagcaggccctggaagacttgatcacctttttctgtgtcattttcagtcaaagagggcctctcttacatcttgtttgctttcaaatccccaaatatcatctccatctcccaattaattttattgtctctttcctctctattcgctttctcctgtttttttttttaaaaaaaagcatgaaaaaggaagagaaaaagtttgatatgccaaggacagattttgaaacagacttggtaaatgttttccttagctccttcatgggcatgctggtgaaagaataaatacatccaattaaagctcatgctggggtcggggagaagaggatactgaaacatttgtgaaatgtatgaatgcacttctgtaaccagatacttctgttcttctgttcaaattgtggggtttttgttacagttaggacgcccatgaagatttaggggtgaaaaaaacagcagagtatttattaaactacagcattgtacaattagcttagtaacactatggaataagctaaaacatatcacagtttttacatgggccaaaacatgaattgagtatgtggtcacatgaaaacacggatgaatgaataaaacactctttggtggtgactgaggcatcattagaaggcccagacgatttccactattcacagcatttccttttctcagaaggactctttatatttccatgtaaatctagatctttggagcaattaagatggaattacaatttctagggagcattttaaggaaaatgttttggctttttcataattttatgtcttacagtatggaattataatacgaaaatctttatatgagttttggcttcttggtatttgtacttattcaggggaaaaagtctttcgattacttatgcctctatagagcttaatttcttgagaaattcaacagtcattttcaccagcataattttatcttaaggaataactaataggaaaagtcagcttaattatttaaggccctagtttctacatataatatattcgatagaaatgaaaatctgccgtggaattaactaataagtagtaacaataaacttcatatttagaatgcaaagtctataaagaataattttacatgatcctcaatatcaactccagtttaaaaagtgttatttttaaaacatttgaaaccaagtactgtttaatttcaatcagaagatgcaaatacatactttgatctatgtttgattttgctaataatatttgaaggagattgcctaccaaggacaaaacaataaatttaaaaatcaaacgatttctccatacgctcatagtcacatatggaattttgagaaaataaagcatgctgtctttaggaatttttatacttctttgtctttcttccttaatatttgcttctagctgctcttggcaatgatgaattgttatgtatgcattaatgttttgcagcccaaaagttgttcacatttttcctatataagatctgtggagtgtgtgtttcaaagagagaactacagaaatgttaaagcaggaaaacctgaatgtgatgtgcacattttcatcccacatggacaatgtatgtgttttaataaatggaattttcagattca

SEQ ID NO: 454873 - DNA, 3425 bp, Homo sapiens
aattcgtttttctctctgctttctcaacagccagatctgccagtgagcctcaggctttaggaactgaagagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagcccccccccccaaaatcctcatgtttctgcttcatattttgaaaaataacaattaaaacagacagctgtactgaggtaagatatgtgtgaccttcttggaatgaatattgtctttagaataccctttgataagctgagctgtcccgtgtagatgcaattcggtttaatggcattgatgtatagtcactgtgcctttctttttctttcttccttctcctctacccctccttccacccctccccattagagtagtgtggagataaggctggactggtctatcagattgaactccaagaatgatcacacaaaatgtttagggagatgttccccgtggtgtatcctcatggtaacaacgacaaaaaatgccggttgtctttgttctcttttcactattcctaacatgtgtacatgatagctttgattctgcaagtaaaagtaaatcctgtgttgtgactggtgctttcatatatttgtgacaatttttgagtaatattgcatgaaaatgtccctatgttacatccattcagaagttttgttgttttactctaaagctgggaaaggaaatgagagggaaaagaccccggagagggaagaaaatctcagtattttgaaaattgagattacttcagagccttagccacacctaaaatacctcctagttaatagtggtataaatgcctcttcaatacgttttccagaatccaaagcattttggtttatccaggacccagggcagcacagctgtcaccaagcaggagagttaaggattcaccatgagctgggaaatgcttttgccatgagtatgagcaaattccctctttccctgaatcatggacattctagattaaaagaacatttttttgtgctcttaacaagaaaaccatggccctcctttgttcaagtatcagaagaaataaacccacagctccagagaaggtgaccattctcagaactccagctattcactctccagggagaaggacctcaaatcgccactctttgggcggcaggtgcggtccccacggccggctctacgaggaagagttctggctcttttgtccactgagatggtcttggtttttcacttaacaaattttttaatggaatctttgtttttgttctccatcttgtttgttagagtctctcggcctttatttacaaattccttgcaactagagcgctccttccccaagatatggtagtgagagtaatttttcattgtagctgtagtctccatcagtaacagcaggccctggaagacttgatcacctttttctgtgtcattttcagtcaaagagggcctctcttacatcttgtttgctttcaaatccccaaatatcatctccatctcccaattaattttattgtctctttcctctctattcgctttctcctgtttttttttttaaaaaaaagcatgaaaaaggaagagaaaaagtttgatatgccaaggacagattttgaaacagacttggtaaatgttttccttagctccttcatgggcatgctggtgaaagaataaatacatccaattaaagctcatgctggggtcggggagaagaggatactgaaacatttgtgaaatgtatgaatgcacttctgtaaccagatacttctgttcttctgttcaaattgtggggtttttgttacagttaggacgcccatgaagatttaggggtgaaaaaaacagcagagtatttattaaactacagcattgtacaattagcttagtaacactatggaataagctaaaacatatcacagtttttacatgggccaaaacatgaattgagtatgtggtcacatgaaaacacggatgaatgaataaaacactctttggtggtgactgaggcatcattagaaggcccagacgatttccactattcacagcatttccttttctcagaaggactctttatatttccatgtaaatctagatctttggagcaattaagatggaattacaatttctagggagcattttaaggaaaatgttttggctttttcataattttatgtcttacagtatggaattataatacgaaaatctttatatgagttttggcttcttggtatttgtacttattcaggggaaaaagtctttcgattacttatgcctctatagagcttaatttcttgagaaattcaacagtcattttcaccagcataattttatcttaaggaataactaataggaaaagtcagcttaattatttaaggccctagtttctacatataatatattcgatagaaatgaaaatctgccgtggaattaactaataagtagtaacaataaacttcatatttagaatgcaaagtctataaagaataattttacatgatcctcaatatcaactccagtttaaaaagtgttatttttaaaacatttgaaaccaagtactgtttaatttcaatcagaagatgcaaatacatactttgatctatgtttgattttgctaataatatttgaaggagattgcctaccaaggacaaaacaataaatttaaaaatcaaacgatttctccatacgctcatagtcacatatggaattttgagaaaataaagcatgctgtctttaggaatttttatacttctttgtctttcttccttaatatttgcttctagctgctcttggcaatgatgaattgttatgtatgcattaatgttttgcagcccaaaagttgttcacatttttcctatataagatctgtggagtgtgtgtttcaaagagagaactacagaaatgttaaagcaggaaaacctgaatgtgatgtgcacattttcatcccacatggacaatgtatgtgttttaataaatggaattttcagattca

SEQ ID NO: 454874 - DNA, 3381 bp, Homo sapiens
gatgaggaagcagaagcttttagaggctgagtatcttgcttcatggagcaaggatttgatgccaggacattgggctctaaagccttgggccttgactgactgtaccagactccagtgttggttgtttttgtctccctttccaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagcccccccccccaaaatcctcatgtttctgcttcatattttgaaaaataacaattaaaacagacagctgtactgaggtaagatatgtgtgaccttcttggaatgaatattgtctttagaataccctttgataagctgagctgtcccgtgtagatgcaattcggtttaatggcattgatgtatagtcactgtgcctttctttttctttcttccttctcctctacccctccttccacccctccccattagagtagtgtggagataaggctggactggtctatcagattgaactccaagaatgatcacacaaaatgtttagggagatgttccccgtggtgtatcctcatggtaacaacgacaaaaaatgccggttgtctttgttctcttttcactattcctaacatgtgtacatgatagctttgattctgcaagtaaaagtaaatcctgtgttgtgactggtgctttcatatatttgtgacaatttttgagtaatattgcatgaaaatgtccctatgttacatccattcagaagttttgttgttttactctaaagctgggaaaggaaatgagagggaaaagaccccggagagggaagaaaatctcagtattttgaaaattgagattacttcagagccttagccacacctaaaatacctcctagttaatagtggtataaatgcctcttcaatacgttttccagaatccaaagcattttggtttatccaggacccagggcagcacagctgtcaccaagcaggagagttaaggattcaccatgagctgggaaatgcttttgccatgagtatgagcaaattccctctttccctgaatcatggacattctagattaaaagaacatttttttgtgctcttaacaagaaaaccatggccctcctttgttcaagtatcagaagaaataaacccacagctccagagaaggtgaccattctcagaactccagctattcactctccagggagaaggacctcaaatcgccactctttgggcggcaggtgcggtccccacggccggctctacgaggaagagttctggctcttttgtccactgagatggtcttggtttttcacttaacaaattttttaatggaatctttgtttttgttctccatcttgtttgttagagtctctcggcctttatttacaaattccttgcaactagagcgctccttccccaagatatggtagtgagagtaatttttcattgtagctgtagtctccatcagtaacagcaggccctggaagacttgatcacctttttctgtgtcattttcagtcaaagagggcctctcttacatcttgtttgctttcaaatccccaaatatcatctccatctcccaattaattttattgtctctttcctctctattcgctttctcctgtttttttttttaaaaaaaagcatgaaaaaggaagagaaaaagtttgatatgccaaggacagattttgaaacagacttggtaaatgttttccttagctccttcatgggcatgctggtgaaagaataaatacatccaattaaagctcatgctggggtcggggagaagaggatactgaaacatttgtgaaatgtatgaatgcacttctgtaaccagatacttctgttcttctgttcaaattgtggggtttttgttacagttaggacgcccatgaagatttaggggtgaaaaaaacagcagagtatttattaaactacagcattgtacaattagcttagtaacactatggaataagctaaaacatatcacagtttttacatgggccaaaacatgaattgagtatgtggtcacatgaaaacacggatgaatgaataaaacactctttggtggtgactgaggcatcattagaaggcccagacgatttccactattcacagcatttccttttctcagaaggactctttatatttccatgtaaatctagatctttggagcaattaagatggaattacaatttctagggagcattttaaggaaaatgttttggctttttcataattttatgtcttacagtatggaattataatacgaaaatctttatatgagttttggcttcttggtatttgtacttattcaggggaaaaagtctttcgattacttatgcctctatagagcttaatttcttgagaaattcaacagtcattttcaccagcataattttatcttaaggaataactaataggaaaagtcagcttaattatttaaggccctagtttctacatataatatattcgatagaaatgaaaatctgccgtggaattaactaataagtagtaacaataaacttcatatttagaatgcaaagtctataaagaataattttacatgatcctcaatatcaactccagtttaaaaagtgttatttttaaaacatttgaaaccaagtactgtttaatttcaatcagaagatgcaaatacatactttgatctatgtttgattttgctaataatatttgaaggagattgcctaccaaggacaaaacaataaatttaaaaatcaaacgatttctccatacgctcatagtcacatatggaattttgagaaaataaagcatgctgtctttaggaatttttatacttctttgtctttcttccttaatatttgcttctagctgctcttggcaatgatgaattgttatgtatgcattaatgttttgcagcccaaaagttgttcacatttttcctatataagatctgtggagtgtgtgtttcaaagagagaactacagaaatgttaaagcaggaaaacctgaatgtgatgtgcacattttcatcccacatggacaatgtatgtgttttaataaatggaattttcagattca

SEQ ID NO: 454875 - DNA, 3578 bp, Homo sapiens
aatggaaatgagagggaaaagaagcaagccgctaacagctaccaagaagaggaggaagtgggagatgcgctgcttcctgtagaaagaacgttgattgaagacaaagctgggtggggactagtccctgggctgcagccgctgctacacatactcacaacgctgccgccgcgctccgtgggcaactcctactactgctgggctgggctgggctgggctgggctgcgccggagctcgcctgcacagatcagctccggagaggggaaaaccacgctcctcggaccaagcctcgggagctaagccagatctgccagtgagcctcaggctttaggaactgaagagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagcccccccccccaaaatcctcatgtttctgcttcatattttgaaaaataacaattaaaacagacagctgtactgaggtaagatatgtgtgaccttcttggaatgaatattgtctttagaataccctttgataagctgagctgtcccgtgtagatgcaattcggtttaatggcattgatgtatagtcactgtgcctttctttttctttcttccttctcctctacccctccttccacccctccccattagagtagtgtggagataaggctggactggtctatcagattgaactccaagaatgatcacacaaaatgtttagggagatgttccccgtggtgtatcctcatggtaacaacgacaaaaaatgccggttgtctttgttctcttttcactattcctaacatgtgtacatgatagctttgattctgcaagtaaaagtaaatcctgtgttgtgactggtgctttcatatatttgtgacaatttttgagtaatattgcatgaaaatgtccctatgttacatccattcagaagttttgttgttttactctaaagctgggaaaggaaatgagagggaaaagaccccggagagggaagaaaatctcagtattttgaaaattgagattacttcagagccttagccacacctaaaatacctcctagttaatagtggtataaatgcctcttcaatacgttttccagaatccaaagcattttggtttatccaggacccagggcagcacagctgtcaccaagcaggagagttaaggattcaccatgagctgggaaatgcttttgccatgagtatgagcaaattccctctttccctgaatcatggacattctagattaaaagaacatttttttgtgctcttaacaagaaaaccatggccctcctttgttcaagtatcagaagaaataaacccacagctccagagaaggtgaccattctcagaactccagctattcactctccagggagaaggacctcaaatcgccactctttgggcggcaggtgcggtccccacggccggctctacgaggaagagttctggctcttttgtccactgagatggtcttggtttttcacttaacaaattttttaatggaatctttgtttttgttctccatcttgtttgttagagtctctcggcctttatttacaaattccttgcaactagagcgctccttccccaagatatggtagtgagagtaatttttcattgtagctgtagtctccatcagtaacagcaggccctggaagacttgatcacctttttctgtgtcattttcagtcaaagagggcctctcttacatcttgtttgctttcaaatccccaaatatcatctccatctcccaattaattttattgtctctttcctctctattcgctttctcctgtttttttttttaaaaaaaagcatgaaaaaggaagagaaaaagtttgatatgccaaggacagattttgaaacagacttggtaaatgttttccttagctccttcatgggcatgctggtgaaagaataaatacatccaattaaagctcatgctggggtcggggagaagaggatactgaaacatttgtgaaatgtatgaatgcacttctgtaaccagatacttctgttcttctgttcaaattgtggggtttttgttacagttaggacgcccatgaagatttaggggtgaaaaaaacagcagagtatttattaaactacagcattgtacaattagcttagtaacactatggaataagctaaaacatatcacagtttttacatgggccaaaacatgaattgagtatgtggtcacatgaaaacacggatgaatgaataaaacactctttggtggtgactgaggcatcattagaaggcccagacgatttccactattcacagcatttccttttctcagaaggactctttatatttccatgtaaatctagatctttggagcaattaagatggaattacaatttctagggagcattttaaggaaaatgttttggctttttcataattttatgtcttacagtatggaattataatacgaaaatctttatatgagttttggcttcttggtatttgtacttattcaggggaaaaagtctttcgattacttatgcctctatagagcttaatttcttgagaaattcaacagtcattttcaccagcataattttatcttaaggaataactaataggaaaagtcagcttaattatttaaggccctagtttctacatataatatattcgatagaaatgaaaatctgccgtggaattaactaataagtagtaacaataaacttcatatttagaatgcaaagtctataaagaataattttacatgatcctcaatatcaactccagtttaaaaagtgttatttttaaaacatttgaaaccaagtactgtttaatttcaatcagaagatgcaaatacatactttgatctatgtttgattttgctaataatatttgaaggagattgcctaccaaggacaaaacaataaatttaaaaatcaaacgatttctccatacgctcatagtcacatatggaattttgagaaaataaagcatgctgtctttaggaatttttatacttctttgtctttcttccttaatatttgcttctagctgctcttggcaatgatgaattgttatgtatgcattaatgttttgcagcccaaaagttgttcacatttttcctatataagatctgtggagtgtgtgtttcaaagagagaactacagaaatgttaaagcaggaaaacctgaatgtgatgtgcacattttcatcccacatggacaatgtatgtgttttaataaatggaattttcagattca

SEQ ID NO: 454876 - DNA, 3693 bp, Homo sapiens
aatggaaatgagagggaaaagaagcaagccgctaacagctaccaagaagaggaggaagtgggagatgcgctgcttcctgtagaaagaacgttgattgaagacaaagctgggtggggactagtccctgggctgcagccgctgctacacatactcacaacgctgccgccgcgctccgtgggcaactcctactactgctgggctgggctgggctgggctgggctgcgccggagctcgcctgcacagatcagctccggagaggggaaaaccacgctcctcggaccaagcctcgggagctaagccagatctgccagtgagcctcaggctttaggaactgaagagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagcccccccccccaaaatcctcatgtttctgcttcatattttgaaaaataacaattaaaacagacagctgtactgaggtaagatatgtgtgaccttcttggaatgaatattgtctttagaataccctttgataagctgagctgtcccgtgtagatgcaattcggtttaatggcattgatgtatagtcactgtgcctttctttttctttcttccttctcctctacccctccttccacccctccccattagagtagtgtggagataaggctggactggtctatcagattgaactccaagaatgatcacacaaaatgtttagggagatgttccccgtggtgtatcctcatggtaacaacgacaaaaaatgccggttgtctttgttctcttttcactattcctaacatgtgtacatgatagctttgattctgcaagtaaaagtaaatcctgtgttgtgactggtgctttcatatatttgtgacaatttttgagtaatattgcatgaaaatgtccctatgttacatccattcagaagttttgttgttttactctaaagctgggaaaggaaatgagagggaaaagaccccggagagggaagaaaatctcagtattttgaaaattgagattacttcagagccttagccacacctaaaatacctcctagttaatagtggtataaatgcctcttcaatacgttttccagaatccaaagcattttggtttatccaggacccagggcagcacagctgtcaccaagcaggagagttaaggattcaccatgagctgggaaatgcttttgccatgagtatgagcaaattccctctttccctgaatcatggacattctagattaaaagaacatttttttgtgctcttaacaagaaaaccatggccctcctttgttcaagtatcagaagaaataaacccacagctccagagaaggtgaccattctcagaactccagctattcactctccagggagaaggacctcaaatcgccactctttgggcggcaggtgcggtccccacggccggctctacgaggaagagttctggctcttttgtccactgagatggtcttggtttttcacttaacaaattttttaatggaatctttgtttttgttctccatcttgtttgttagagtctctcggcctttatttacaaattccttgcaactagagcgctccttccccaagatatggtagtgagagtaatttttcattgtagctgtagtctccatcagtaacagcaggccctggaagacttgatcacctttttctgtgtcattttcagtcaaagagggcctctcttacatcttgtttgctttcaaatccccaaatatcatctccatctcccaattaattttattgtctctttcctctctattcgctttctcctgtttttttttttaaaaaaaagcatgaaaaaggaagagaaaaagtttgatatgccaaggacagattttgaaacagacttggtaaatgttttccttagctccttcatgggcatgctggtgaaagaataaatacatccaattaaagctcatgctggggtcggggagaagaggatactgaaacatttgtgaaatgtatgaatgcacttctgtaaccagatacttctgttcttctgttcaaattgtggggtttttgttacagttaggacgcccatgaagatttaggggtgaaaaaaacagcagagtatttattaaactacagcattgtacaattagcttagtaacactatggaataagctaaaacatatcacagtttttacatgggccaaaacatgaattgagtatgtggtcacatgaaaacacggatgaatgaataaaacactctttggtggtgactgaggcatcattagaaggcccagacgatttccactattcacagcatttccttttctcagaaggactctttatatttccatgtaaatctagatctttggagcaattaagatggaattacaatttctagggagcattttaaggaaaatgttttggctttttcataattttatgtcttacagtatggaattataatacgaaaatctttatatgagttttggcttcttggtatttgtacttattcaggggaaaaagtctttcgattacttatgcctctatagagcttaatttcttgagaaattcaacagtcattttcaccagcataattttatcttaaggaataactaataggaaaagtcagcttaattatttaaggccctagtttctacatataatatattcgatagaaatgaaaatctgccgtggaattaactaataagtagtaacaataaacttcatatttagaatgcaaagtctataaagaataattttacatgatcctcaatatcaactccagtttaaaaagtgttatttttaaaacatttgaaaccaagtactgtttaatttcaatcagaagatgcaaatacatactttgatctatgtttgattttgctaataatatttgaaggagattgcctaccaaggacaaaacaataaatttaaaaatcaaacgatttctccatacgctcatagtcacatatggaattttgagaaaataaagcatgctgtctttaggaatttttatacttctttgtctttcttccttaatatttgcttctagctgctcttggcaatgatgaattgttatgtatgcattaatgttttgcagcccaaaagttgttcacatttttcctatataagatctgtggagtgtgtgtttcaaagagagaactacagaaatgttaaagcaggaaaacctgaatgtgatgtgcacattttcatcccacatggacaatgtatgtgttttaataaatggaattttcagattca

SEQ ID NO: 454877 - DNA, 3583 bp, Homo sapiens
agcggagtgccgtgacaggagagaaaagcactcctcctcgataccgtatctccgccaacttaatcacagctgccggtgaaggctcattgaggtaagggaatcgagagaggtaggtgttacatggtatatctcatctaatcacgagcctccatcctgtattgcgcgcatgcaagctatagcaccagacaagggcaatacgacgaaccacccgacgcgagagaaagctttgtgatatcacgccacgccatgtaatcgtactgtgtagaggcccatctcagtcagcaacagcgcatagacccagctgtccactgctgcctgcacaattctgatttgctttcctgtgactgccacagtgcctgggccgacgccgcctgcctggtttccctgctgccgggcttccgatttgcctgctgtcagggcagactgatacgtgttgcctcgtcgtccaatccctctgtagatgctcctagtgctaagaggcggcgtcctctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagcccccccccccaaaatcctcatgtttctgcttcatattttgaaaaataacaattaaaacagacagctgtactgaggtaagatatgtgtgaccttcttggaatgaatattgtctttagaataccctttgataagctgagctgtcccgtgtagatgcaattcggtttaatggcattgatgtatagtcactgtgcctttctttttctttcttccttctcctctacccctccttccacccctccccattagagtagtgtggagataaggctggactggtctatcagattgaactccaagaatgatcacacaaaatgtttagggagatgttccccgtggtgtatcctcatggtaacaacgacaaaaaatgccggttgtctttgttctcttttcactattcctaacatgtgtacatgatagctttgattctgcaagtaaaagtaaatcctgtgttgtgactggtgctttcatatatttgtgacaatttttgagtaatattgcatgaaaatgtccctatgttacatccattcagaagttttgttgttttactctaaagctgggaaaggaaatgagagggaaaagaccccggagagggaagaaaatctcagtattttgaaaattgagattacttcagagccttagccacacctaaaatacctcctagttaatagtggtataaatgcctcttcaatacgttttccagaatccaaagcattttggtttatccaggacccagggcagcacagctgtcaccaagcaggagagttaaggattcaccatgagctgggaaatgcttttgccatgagtatgagcaaattccctctttccctgaatcatggacattctagattaaaagaacatttttttgtgctcttaacaagaaaaccatggccctcctttgttcaagtatcagaagaaataaacccacagctccagagaaggtgaccattctcagaactccagctattcactctccagggagaaggacctcaaatcgccactctttgggcggcaggtgcggtccccacggccggctctacgaggaagagttctggctcttttgtccactgagatggtcttggtttttcacttaacaaattttttaatggaatctttgtttttgttctccatcttgtttgttagagtctctcggcctttatttacaaattccttgcaactagagcgctccttccccaagatatggtagtgagagtaatttttcattgtagctgtagtctccatcagtaacagcaggccctggaagacttgatcacctttttctgtgtcattttcagtcaaagagggcctctcttacatcttgtttgctttcaaatccccaaatatcatctccatctcccaattaattttattgtctctttcctctctattcgctttctcctgtttttttttttaaaaaaaagcatgaaaaaggaagagaaaaagtttgatatgccaaggacagattttgaaacagacttggtaaatgttttccttagctccttcatgggcatgctggtgaaagaataaatacatccaattaaagctcatgctggggtcggggagaagaggatactgaaacatttgtgaaatgtatgaatgcacttctgtaaccagatacttctgttcttctgttcaaattgtggggtttttgttacagttaggacgcccatgaagatttaggggtgaaaaaaacagcagagtatttattaaactacagcattgtacaattagcttagtaacactatggaataagctaaaacatatcacagtttttacatgggccaaaacatgaattgagtatgtggtcacatgaaaacacggatgaatgaataaaacactctttggtggtgactgaggcatcattagaaggcccagacgatttccactattcacagcatttccttttctcagaaggactctttatatttccatgtaaatctagatctttggagcaattaagatggaattacaatttctagggagcattttaaggaaaatgttttggctttttcataattttatgtcttacagtatggaattataatacgaaaatctttatatgagttttggcttcttggtatttgtacttattcaggggaaaaagtctttcgattacttatgcctctatagagcttaatttcttgagaaattcaacagtcattttcaccagcataattttatcttaaggaataactaataggaaaagtcagcttaattatttaaggccctagtttctacatataatatattcgatagaaatgaaaatctgccgtggaattaactaataagtagtaacaataaacttcatatttagaatgcaaagtctataaagaataattttacatgatcctcaatatcaactccagtttaaaaagtgttatttttaaaacatttgaaaccaagtactgtttaatttcaatcagaagatgcaaatacatactttgatctatgtttgattttgctaataatatttgaaggagattgcctaccaaggacaaaacaataaatttaaaaatcaaacgatttctccatacgctcatagtcacatatggaattttgagaaaataaagcatgctgtctttaggaatttttatacttctttgtctttcttccttaatatttgcttctagctgctcttggcaatgatgaattgttatgtatgcattaatgttttgcagcccaaaagttgttcacatttttcctatataagatctgtggagtgtgtgtttcaaagagagaactacagaaatgttaaagcaggaaaacctgaatgtgatgtgcacattttcatcccacatggacaatgtatgtgttttaataaatggaattttcagattca

SEQ ID NO: 454878 - DNA, 1374 bp, Homo sapiens
aatggaaatgagagggaaaagaagcaagccgctaacagctaccaagaagaggaggaagtgggagatgcgctgcttcctgtagaaagaacgttgattgaagacaaagctgggtggggactagtccctgggctgcagccgctgctacacatactcacaacgctgccgccgcgctccgtgggcaactcctactactgctgggctgggctgggctgggctgggctgcgccggagctcgcctgcacagatcagctccggagaggggaaaaccacgctcctcggaccaagcctcgggagctaagccagatctgccagtgagcctcaggctttaggaactgaagagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagcccccccccccaaaatcctcatgtttctgcttcatattttgaaaaataacaattaaaacagacagctgtactgaggtaagatatgtgtgaccttcttggaatgaatattgtctttagaataccctttgataagctgagctgtcccgtgtagatgcaattcggtttaatggcattgatgtatagtcactgtgcctttctttttctttcttccttctcctctacccctccttccacccctccccattagagtagtgtggagataaggctggactggtctatcagattgaactccaagaatgatcacacaaaatgtttagggagatgttccccgtggtgtatcctcatggtaacaacgacaaaaaatgccggttgtctttgttctcttttcactattcctaacatgtgtacatgatagctttgattctgcaagtaaaagtaaatcctgaatgtgatgtgcacattttcatcccacatggacaatgtatgtgttttaataaatggaattttcagattca

SEQ ID NO: 454879 - DNA, 3962 bp, Homo sapiens
cggagtgctgtttttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagcgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccaggtgagttcaaccagcaaggccaggagggaggtgggaggaggtcagagggaaagggcatctgtgtggacagtcaccaggccctgctcccaacccctgcccttcttggcctcagccaagaaaaggagatacaggtatggttaacaaggaaaatgactcactgctccaaatcccagatgccttcaggtaatccctacccctatcttatcaatgcactcagaggtcctgcctttaactggcttctatgttgttctagcaccatcttctgcagagcccaaattgccctgcttcccctctctcctgcctctaccccttccccaaccaccaggtaggtacctagggtcctccggggaggaagggaggtgaccatggcccccagggataggagcagagagaagactgggatccagcatccatctggctacaactgaaatgctttccctcttccctgacttccctgggtaacccttagggaagggaacctatagaggtgggggtttcaggtatcagattgtccccttctgccttcccttttattcccaggttcaagggggcaggcacagggaagagagatttgatcatctagtcccggttttgcctggatgtgagatgggctcagggcagggagggggtgatgctgtcatccttctcggctggagcaggaagatgaaggacgatgtcagactcattttcagcctcattaggcagcagacggagatggagggaggagagcaggaggctgggggatgggctctgcactgcagagaccagcagggactaaagaagagaggacatggggaactggaaaaataagccttccaggattgtggggagaaagacgctgtgggagaggccaggatgctgcattaggcacaggataacctgggaacccaggcacatgggtcctgctctccgaagtctgcaagtcaagaagggaacagagcacgccgaccctctccctttcccctctgtctctcttagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgta

SEQ ID NO: 454880 - DNA, 719 bp, Homo sapiens
cggagtgctgtttttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaaggtacaagggaagatggaaaattgggagagaggagccaagggagtggaggtttgaaagaaggtagtgggctcagaaacattaaaagttaggcacaaaggacaaggaaaaataaacgaaaataaatataatgagaatatatccaacagcgctcagcagatagagaatcacgggattatcgcagaatcagggacatagaaacagaaggaacttcagagggcatctagtcccctgtcctacccaaagaaggaaaaatgggggagtaaggaagagggaaaggtagaattatgtggtgagaagagggaaagacctgggttcaaatctcacctctaacacttacaagctgtttggccttgggcaaattacataacctccctgtgt

SEQ ID NO: 454881 - DNA, 569 bp, Homo sapiens
ccactgcactccagcctgggcgatggagcaagactctgtctcaagataaaataaaataaaaagtgttaccacagtgtctggtacatggtacgcactcactacatggtaactagcattattatgattatgatagaggggcagtgggtttgggaaagaaaggaaggagagggacaggcagaaaggagggagaagagtatggcctgtgggaggtggagaagagaagaaacagtatatggaacaccgagcaaggggctggggccaaggacagtggattattggggtcctgggtccattcttcttcccacagccagctacctgcccagcccgttggagaagcaacaagaacgcatctagacagactcgccctccctgcgggcgccatttggtttccccaaaccaagagaatattaggtgacggctgtggcaagaattccactttgggcatctgcttctccaacgggctgggacggggaagctactgtgggaaacactctaccttctcttcttctcttaaccgtttctcttcttcctttttccttttttcctcaagttagacctgtgagaccgca

SEQ ID NO: 454882 - DNA, 650 bp, Homo sapiens
tagccttgttctttactgacacattagtgtccctccactttccctttctcttgtcattgttgccactgtagctccatcctgccccccttattcaacccctcagccctttcttccatccatagaaggtagttccatgaccatacctttctccaaccttgggctttcacaggtggaggctgcctgtgttcgggattaccacacatttgtgtggtcttccgtgcctgaaagtacaactgatggttcccccattcacaccagtgtccagttccaaggtacaagggaagatggaaaattgggagagaggagccaagggagtggaggtttgaaagaaggtagtgggctcagaaacattaaaagttaggcacaaaggacaaggaaaaataaacgaaaataaatataatgagaatatatccaacagcgctcagcagatagagaatcacgggattatcgcagaatcagggacatagaaacagaaggaacttcagagggcatctagtcccctgtcctacccaaagaaggaaaaatgggggagtaaggaagagggaaaggtagaattatgtggtgagaagagggaaagacctgggttcaaatctcacctctaacacttacaagctgtttggccttgggcaaattacataacctccctgtgt

SEQ ID NO: 454883 - DNA, 4194 bp, Homo sapiens
cggagtgctgtttttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagcgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagtccgtgtagccccaatcttgtaacacctcttccccactctacctcccgctgttgaggaaggctccatgtaaccttgctgggagctgcctttgccttctatgtgttttgccttttctttcccagaccctggcccctgtttagtctaatgatacccctcatccagaggagacagctggtccaactcctcacaacacatccttttttcttctctgcctgcttcatctcctacaggctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccaggtgagttcaaccagcaaggccaggagggaggtgggaggaggtcagagggaaagggcatctgtgtggacagtcaccaggccctgctcccaacccctgcccttcttggcctcagccaagaaaaggagatacaggtatggttaacaaggaaaatgactcactgctccaaatcccagatgccttcaggtaatccctacccctatcttatcaatgcactcagaggtcctgcctttaactggcttctatgttgttctagcaccatcttctgcagagcccaaattgccctgcttcccctctctcctgcctctaccccttccccaaccaccaggtaggtacctagggtcctccggggaggaagggaggtgaccatggcccccagggataggagcagagagaagactgggatccagcatccatctggctacaactgaaatgctttccctcttccctgacttccctgggtaacccttagggaagggaacctatagaggtgggggtttcaggtatcagattgtccccttctgccttcccttttattcccaggttcaagggggcaggcacagggaagagagatttgatcatctagtcccggttttgcctggatgtgagatgggctcagggcagggagggggtgatgctgtcatccttctcggctggagcaggaagatgaaggacgatgtcagactcattttcagcctcattaggcagcagacggagatggagggaggagagcaggaggctgggggatgggctctgcactgcagagaccagcagggactaaagaagagaggacatggggaactggaaaaataagccttccaggattgtggggagaaagacgctgtgggagaggccaggatgctgcattaggcacaggataacctgggaacccaggcacatgggtcctgctctccgaagtctgcaagtcaagaagggaacagagcacgccgaccctctccctttcccctctgtctctcttagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgta

SEQ ID NO: 454884 - DNA, 3722 bp, Homo sapiens
cggagtgctgtttttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagcgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccaggtgagttcaaccagcaaggccaggagggaggtgggaggaggtcagagggaaagggcatctgtgtggacagtcaccaggccctgctcccaacccctgcccttcttggcctcagccaagaaaaggagatacaggtatggttaacaaggaaaatgactcactgctccaaatcccagatgccttcaggtaatccctacccctatcttatcaatgcactcagaggtcctgcctttaactggcttctatgttgttctagcaccatcttctgcagagcccaaattgccctgcttcccctctctcctgcctctaccccttccccaaccaccaggtaggtacctagggtcctccggggaggaagggaggtgaccatggcccccagggataggagcagagagaagactgggatccagcatccatctggctacaactgaaatgctttccctcttccctgacttccctgggtaacccttagggaagggaacctatagaggtgggggtttcaggtatcagattgtccccttctgccttcccttttattcccaggttcaagggggcaggcacagggaagagagatttgatcatctagtcccggttttgcctggatgtgagatgggctcagggcagggagggggtgatgctgtcatccttctcggctggagcaggaagatgaaggacgatgtcagactcattttcagcctcattaggcagcagacggagatggagggaggagagcaggaggctgggggatgggctctgcactgcagagaccagcagggactaaagaagagaggacatggggaactggaaaaataagccttccaggattgtggggagaaagacgctgtgggagaggccaggatgctgcattaggcacaggataacctgggaacccaggcacatgggtcctgctctccgaagtctgcaagtcaagaagggaacagagcacgccgaccctctccctttcccctctgtctctcttagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgta

SEQ ID NO: 454885 - DNA, 4032 bp, Homo sapiens
cggagtgctgtttttgttgttggtgaaaggtgaggggaacagctgatccgtctgttggagattagttgctgctttctgatgtcataactcattcctggatacagctgggtcaacaagcttaggagtaggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagcgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccaggtgagttcaaccagcaaggccaggagggaggtgggaggaggtcagagggaaagggcatctgtgtggacagtcaccaggccctgctcccaacccctgcccttcttggcctcagccaagaaaaggagatacaggtatggttaacaaggaaaatgactcactgctccaaatcccagatgccttcaggtaatccctacccctatcttatcaatgcactcagaggtcctgcctttaactggcttctatgttgttctagcaccatcttctgcagagcccaaattgccctgcttcccctctctcctgcctctaccccttccccaaccaccaggtaggtacctagggtcctccggggaggaagggaggtgaccatggcccccagggataggagcagagagaagactgggatccagcatccatctggctacaactgaaatgctttccctcttccctgacttccctgggtaacccttagggaagggaacctatagaggtgggggtttcaggtatcagattgtccccttctgccttcccttttattcccaggttcaagggggcaggcacagggaagagagatttgatcatctagtcccggttttgcctggatgtgagatgggctcagggcagggagggggtgatgctgtcatccttctcggctggagcaggaagatgaaggacgatgtcagactcattttcagcctcattaggcagcagacggagatggagggaggagagcaggaggctgggggatgggctctgcactgcagagaccagcagggactaaagaagagaggacatggggaactggaaaaataagccttccaggattgtggggagaaagacgctgtgggagaggccaggatgctgcattaggcacaggataacctgggaacccaggcacatgggtcctgctctccgaagtctgcaagtcaagaagggaacagagcacgccgaccctctccctttcccctctgtctctcttagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgta

SEQ ID NO: 454886 - DNA, 3928 bp, Homo sapiens
ccactgcactccagcctgggcgatggagcaagactctgtctcaagataaaataaaataaaaagtgttaccacagtgtctggtacatggtacgcactcactacatggtaactagcattattatgattatgatagaggggcagtgggtttgggaaagaaaggaaggagagggacaggcagaaaggagggagaagagtatggcctgtgggaggtggagaagagaagaaacagtatatggaacaccgagcaaggggctggggccaaggacagtggattattggggtcctgggtccattcttcttcccacagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagcgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccaggtgagttcaaccagcaaggccaggagggaggtgggaggaggtcagagggaaagggcatctgtgtggacagtcaccaggccctgctcccaacccctgcccttcttggcctcagccaagaaaaggagatacaggtatggttaacaaggaaaatgactcactgctccaaatcccagatgccttcaggtaatccctacccctatcttatcaatgcactcagaggtcctgcctttaactggcttctatgttgttctagcaccatcttctgcagagcccaaattgccctgcttcccctctctcctgcctctaccccttccccaaccaccaggtaggtacctagggtcctccggggaggaagggaggtgaccatggcccccagggataggagcagagagaagactgggatccagcatccatctggctacaactgaaatgctttccctcttccctgacttccctgggtaacccttagggaagggaacctatagaggtgggggtttcaggtatcagattgtccccttctgccttcccttttattcccaggttcaagggggcaggcacagggaagagagatttgatcatctagtcccggttttgcctggatgtgagatgggctcagggcagggagggggtgatgctgtcatccttctcggctggagcaggaagatgaaggacgatgtcagactcattttcagcctcattaggcagcagacggagatggagggaggagagcaggaggctgggggatgggctctgcactgcagagaccagcagggactaaagaagagaggacatggggaactggaaaaataagccttccaggattgtggggagaaagacgctgtgggagaggccaggatgctgcattaggcacaggataacctgggaacccaggcacatgggtcctgctctccgaagtctgcaagtcaagaagggaacagagcacgccgaccctctccctttcccctctgtctctcttagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgta

SEQ ID NO: 454887 - DNA, 3922 bp, Homo sapiens
cggagtgctgtttttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagcgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccaggtgagttcaaccagcaaggccaggagggaggtgggaggaggtcagagggaaagggcatctgtgtggacagtcaccaggccctgctcccaacccctgcccttcttggcctcagccaagaaaaggagatacaggtatggttaacaaggaaaatgactcactgctccaaatcccagatgccttcaggtaatccctacccctatcttatcaatgcactcagaggtcctgcctttaactggcttctatgttgttctagcaccatcttctgcagagcccaaattgccctgcttcccctctctcctgcctctaccccttccccaaccaccaggtaggtacctagggtcctccggggaggaagggaggtgaccatggcccccagggataggagcagagagaagactgggatccagcatccatctggctacaactgaaatgctttccctcttccctgacttccctgggtaacccttagggaagggaacctatagaggtgggggtttcaggtatcagattgtccccttctgccttcccttttattcccaggttcaagggggcaggcacagggaagagagatttgatcatctagtcccggttttgcctggatgtgagatgggctcagggcagggagggggtgatgctgtcatccttctcggctggagcaggaagatgaaggacgatgtcagactcattttcagcctcattaggcagcagacggagatggagggaggagagcaggaggctgggggatgggctctgcactgcagagaccagcagggactaaagaagagaggacatggggaactggaaaaataagccttccaggattgtggggagaaagacgctgtgggagaggccaggatgctgcattaggcacaggataacctgggaacccaggcacatgggtcctgctctccgaagtctgcaagtcaagaagggaacagagcacgccgaccctctccctttcccctctgtctctcttagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatcca

SEQ ID NO: 454888 - DNA, 2459 bp, Homo sapiens
cgggttcaagagattcttctgtctcagcctcctgagtagctgggattacaggcacccgccaccacgcccagctaattttttgtatttttagtagagatggggtttcaccatgttggccaggctggtctggaacttctgacctcaggtgatccgcccacctcggcctcccaaatcatgccgagattgcaggcatgagccactgcacctggccttgtgttgttttttcaaaacgcctctcctgcctcactcttcctaagcccctcaggtcactgtcctagccttggctgctcttcccatacctgtcccaatgtgctgctcccccatcttgggacaccaccccaaagcccaaccctgtctctttggcatccaggaggctgaagatgagaagtcagtcctgatggcagctgtgcagagtgggggtgaggaggccaacttactgcttcctgaactgggcagtgccttctatgacatggccaggtgagttcaaccagcaaggccaggagggaggtgggaggaggtcagagggaaagggcatctgtgtggacagtcaccaggccctgctcccaacccctgcccttcttggcctcagccaagaaaaggagatacaggtatggttaacaaggaaaatgactcactgctccaaatcccagatgccttcaggtaatccctacccctatcttatcaatgcactcagaggtcctgcctttaactggcttctatgttgttctagcaccatcttctgcagagcccaaattgccctgcttcccctctctcctgcctctaccccttccccaaccaccaggtaggtacctagggtcctccggggaggaagggaggtgaccatggcccccagggataggagcagagagaagactgggatccagcatccatctggctacaactgaaatgctttccctcttccctgacttccctgggtaacccttagggaagggaacctatagaggtgggggtttcaggtatcagattgtccccttctgccttcccttttattcccaggttcaagggggcaggcacagggaagagagatttgatcatctagtcccggttttgcctggatgtgagatgggctcagggcagggagggggtgatgctgtcatccttctcggctggagcaggaagatgaaggacgatgtcagactcattttcagcctcattaggcagcagacggagatggagggaggagagcaggaggctgggggatgggctctgcactgcagagaccagcagggactaaagaagagaggacatggggaactggaaaaataagccttccaggattgtggggagaaagacgctgtgggagaggccaggatgctgcattaggcacaggataacctgggaacccaggcacatgggtcctgctctccgaagtctgcaagtcaagaagggaacagagcacgccgaccctctccctttcccctctgtctctcttagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgta

SEQ ID NO: 454889 - DNA, 4012 bp, Homo sapiens
cggagtgctgtttttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagcgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccaggtgagttcaaccagcaaggccaggagggaggtgggaggaggtcagagggaaagggcatctgtgtggacagtcaccaggccctgctcccaacccctgcccttcttggcctcagccaagaaaaggagatacaggtatggttaacaaggaaaatgactcactgctccaaatcccagatgccttcaggtaatccctacccctatcttatcaatgcactcagaggtcctgcctttaactggcttctatgttgttctagcaccatcttctgcagagcccaaattgccctgcttcccctctctcctgcctctaccccttccccaaccaccaggtaggtacctagggtcctccggggaggaagggaggtgaccatggcccccagggataggagcagagagaagactgggatccagcatccatctggctacaactgaaatgctttccctcttccctgacttccctgggtaacccttagggaagggaacctatagaggtgggggtttcaggtatcagattgtccccttctgccttcccttttattcccaggttcaagggggcaggcacagggaagagagatttgatcatctagtcccggttttgcctggatgtgagatgggctcagggcagggagggggtgatgctgtcatccttctcggctggagcaggaagatgaaggacgatgtcagactcattttcagcctcattaggcagcagacggagatggagggaggagagcaggaggctgggggatgggctctgcactgcagagaccagcagggactaaagaagagaggacatggggaactggaaaaataagccttccaggattgtggggagaaagacgctgtgggagaggccaggatgctgcattaggcacaggataacctgggaacccaggcacatgggtcctgctctccgaagtctgcaagtcaagaagggaacagagcacgccgaccctctccctttcccctctgtctctcttagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccaaaaaacaaaatcctttcctttacctctcatctctccttcatcacctctccttcctctttcctcctcccccccctctctctccctcctcct

SEQ ID NO: 454890 - DNA, 3630 bp, Homo sapiens
cggagtgctgtttttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagcgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccaggtgagttcaaccagcaaggccaggagggaggtgggaggaggtcagagggaaagggcatctgtgtggacagtcaccaggccctgctcccaacccctgcccttcttggcctcagccaagaaaaggagatacaggtatggttaacaaggaaaatgactcactgctccaaatcccagatgccttcaggtaatccctacccctatcttatcaatgcactcagaggtcctgcctttaactggcttctatgttgttctagcaccatcttctgcagagcccaaattgccctgcttcccctctctcctgcctctaccccttccccaaccaccaggtaggtacctagggtcctccggggaggaagggaggtgaccatggcccccagggataggagcagagagaagactgggatccagcatccatctggctacaactgaaatgctttccctcttccctgacttccctgggtaacccttagggaagggaacctatagaggtgggggtttcaggtatcagattgtccccttctgccttcccttttattcccaggttcaagggggcaggcacagggaagagagatttgatcatctagtcccggttttgcctggatgtgagatgggctcagggcagggagggggtgatgctgtcatccttctcggctggagcaggaagatgaaggacgatgtcagactcattttcagcctcattaggcagcagacggagatggagggaggagagcaggaggctgggggatgggctctgcactgcagagaccagcagggactaaagaagagaggacatggggaactggaaaaataagccttccaggattgtggggagaaagacgctgtgggagaggccaggatgctgcattaggcacaggataacctgggaacccaggcacatgggtcctgctctccgaagtctgcaagtcaagaagggaacagagcacgccgaccctctccctttcccctctgtctctcttagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctccctctccaggtccccccacagcaataaaagcttccccctgatatccatccctttgtagtttgaacaaatatatttatatgatatgta

SEQ ID NO: 454891 - DNA, 1300 bp, Homo sapiens
cggagtgctgtttttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacaaggtagagccgagctcggctctagcttgtctgacttcatctacctgcgtcatgttcctctgcgcagagtccgacgtgtacactttgctgcaggtgttgtgtctggccctggtttggatcctcaagtcaacggtggctgctatcatttttccagtgatgatcttggcactggtagctgtcagaaaaaggcgtggactacctcttctcccagcatgacctcagcttcctggatgatgtcattccagacaaggacaccgaccaagaaggcggatgacgatgacatgggaagacgacgacgggaagtctggacggtgagcaggatgattctgtctgcccatactcagatgaagtccatgtcttaaatccattggcgtcatgtacagcagcttcctagcgaagcaacttctgggagaagatacatatcttgacgcagggtcatgtgtaagtctt

SEQ ID NO: 454892 - DNA, 1481 bp, Homo sapiens
  misc_feature (1417)..(1417): n is a, c, g, or t
cggagtgctgtttttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggtgggagctgggccaggtaggggacagggcctggctgctcacccagcatccaaaatctgaacccagtgaagagggtgaaggagagatgttagtgggcttttacaatggttctggcatcaaggaaataggtttaaggggtagtggctgggattaaacttgatgtgacaagagacatgttccaaacgtgtaatgagactcagttctttgaacataggaatgctggggtaaggtggaggtggccacgttgataggtaagggaatgttcccttacagtttctttttcaaggaaggcaatgtgatagccaggtggaagcagtcagaccctggtgtgctcttcctaagcctttgttccaccacttgagagatgagtcccaacctcccttttcttctgggggaaacttaatttcaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggtgaggggagtccactgaccccgtcacttcctctcccttccatgacccccgcactccagccccctctctcaggcaagcagacctgctgtctgcctcacacgctttctctttccctctcaccctcactcaagctagttactggggatacccttttctgccgagctctcncccgtcttgcccgatcctcctgttgtattccgtccccctcttatatcatgatcctcacctgctt

SEQ ID NO: 454893 - DNA, 442 bp, Homo sapiens
gtgttcttggtttgtgaaggactctgtgcttaactctcactgccccctcagcaactgcagctttctgccgaggccttggcccggtcattcttgtccagtttgataggttcaggaaattcgttgtattgactccactcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgta

SEQ ID NO: 454894 - DNA, 472 bp, Homo sapiens
gaagaatgttaggttctttttgaactatctcccctttcctcaacgttaaatatacatttccacttcttggggccccttacttcccactttctagtctgttccctgccctggggtggggctttcctggctccaggcccccacattccatctccccacccccaccacgttcctgctaagcgcctcactccacccttgaagttgccgcctccagaattcttgacttcctggaataataagtcaagggacagaacctgtctttccttatatcctccccttccctttgtctcttggatgccagcagaagctttctgcttccctagaattcatgggggtaggcagctcagagagatgaaaagagctgagagctcaggagcctaaggatttgggctcagttcccctcgacccccagccatattctagctctgaaaactcaaccattcctttcagagattagttgctgctttctgatgtc

SEQ ID NO: 454895 - DNA, 489 bp, Homo sapiens
agacaggatggggacggacttggaaggccagacctacgtcctagagactaagagtgatacctcaaaaatgtcccgtaaccctcagggactagaaaccaggtatgccttatctccaggtgtagtggcaggggctgtgagtgtgtggtgctggagctgtggggggaaggaggtggactggaaagactttaggctatcaaccctttctttcataggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtatctctggaaccccttttggcttaggtttatgggctgtgagttggttggaataaggggaatgattgggctcttggattctcaacctcaggttgat

SEQ ID NO: 454896 - DNA, 2984 bp, Homo sapiens
cggagtgctgtttttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagcgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgta

SEQ ID NO: 454897 - DNA, 2950 bp, Homo sapiens
ccgatacgccccggatttaccgggcatgaaccgtgaccgggcaccgctagcatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagcgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatcca

SEQ ID NO: 454898 - DNA, 3824 bp, Homo sapiens
cggagtgctgtttttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagcgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccaggtgagttcaaccagcaaggccaggagggaggtgggaggaggtcagagggaaagggcatctgtgtggacagtcaccaggccctgctcccaacccctgcccttcttggcctcagccaagaaaaggagatacaggtatggttaacaaggaaaatgactcactgctccaaatcccagatgccttcaggtaatccctacccctatcttatcaatgcactcagaggtcctgcctttaactggcttctatgttgttctagcaccatcttctgcagagcccaaattgccctgcttcccctctctcctgcctctaccccttccccaaccaccaggtaggtacctagggtcctccggggaggaagggaggtgaccatggcccccagggataggagcagagagaagactgggatccagcatccatctggctacaactgaaatgctttccctcttccctgacttccctgggtaacccttagggaagggaacctatagaggtgggggtttcaggtatcagattgtccccttctgccttcccttttattcccaggttcaagggggcaggcacagggaagagagatttgatcatctagtcccggttttgcctggatgtgagatgggtctgcactgcagagaccagcagggactaaagaagagaggacatggggaactggaaaaataagccttccaggattgtggggagaaagacgctgtgggagaggccaggatgctgcattaggcacaggataacctgggaacccaggcacatgggtcctgctctccgaagtctgcaagtcaagaagggaacagagcacgccgaccctctccctttcccctctgtctctcttagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgta

SEQ ID NO: 454899 - DNA, 4371 bp, Homo sapiens
cggagtgctgtttttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggtgggagctgggccaggtaggggacagggcctggctgctcacccagcatccaaaatctgaacccagtgaagagggtgaaggagagatgttagtgggcttttacaatggttctggcatcaaggaaataggtttaaggggtagtggctgggattaaacttgatgtgacaagagacatgttccaaacgtgtaatgagactcagttctttgaacataggaatgctggggtaaggtggaggtggccacgttgataggtaagggaatgttcccttacagtttctttttcaaggaaggcaatgtgatagccaggtggaagcagtcagaccctggtgtgctcttcctaagcctttgttccaccacttgagagatgagtcccaacctcccttttcttctgggggaaacttaatttcaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagcgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccaggtgagttcaaccagcaaggccaggagggaggtgggaggaggtcagagggaaagggcatctgtgtggacagtcaccaggccctgctcccaacccctgcccttcttggcctcagccaagaaaaggagatacaggtatggttaacaaggaaaatgactcactgctccaaatcccagatgccttcaggtaatccctacccctatcttatcaatgcactcagaggtcctgcctttaactggcttctatgttgttctagcaccatcttctgcagagcccaaattgccctgcttcccctctctcctgcctctaccccttccccaaccaccaggtaggtacctagggtcctccggggaggaagggaggtgaccatggcccccagggataggagcagagagaagactgggatccagcatccatctggctacaactgaaatgctttccctcttccctgacttccctgggtaacccttagggaagggaacctatagaggtgggggtttcaggtatcagattgtccccttctgccttcccttttattcccaggttcaagggggcaggcacagggaagagagatttgatcatctagtcccggttttgcctggatgtgagatgggctcagggcagggagggggtgatgctgtcatccttctcggctggagcaggaagatgaaggacgatgtcagactcattttcagcctcattaggcagcagacggagatggagggaggagagcaggaggctgggggatgggctctgcactgcagagaccagcagggactaaagaagagaggacatggggaactggaaaaataagccttccaggattgtggggagaaagacgctgtgggagaggccaggatgctgcattaggcacaggataacctgggaacccaggcacatgggtcctgctctccgaagtctgcaagtcaagaagggaacagagcacgccgaccctctccctttcccctctgtctctcttagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgta

SEQ ID NO: 454900 - DNA, 3968 bp, Homo sapiens
ccgatacgccccggatttaccgggcatgaaccgtgaccgggcaccgctagcatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagcgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccaggtgagttcaaccagcaaggccaggagggaggtgggaggaggtcagagggaaagggcatctgtgtggacagtcaccaggccctgctcccaacccctgcccttcttggcctcagccaagaaaaggagatacaggtatggttaacaaggaaaatgactcactgctccaaatcccagatgccttcaggtaatccctacccctatcttatcaatgcactcagaggtcctgcctttaactggcttctatgttgttctagcaccatcttctgcagagcccaaattgccctgcttcccctctctcctgcctctaccccttccccaaccaccaggtaggtacctagggtcctccggggaggaagggaggtgaccatggcccccagggataggagcagagagaagactgggatccagcatccatctggctacaactgaaatgctttccctcttccctgacttccctgggtaacccttagggaagggaacctatagaggtgggggtttcaggtatcagattgtccccttctgccttcccttttattcccaggttcaagggggcaggcacagggaagagagatttgatcatctagtcccggttttgcctggatgtgagatgggctcagggcagggagggggtgatgctgtcatccttctcggctggagcaggaagatgaaggacgatgtcagactcattttcagcctcattaggcagcagacggagatggagggaggagagcaggaggctgggggatgggctctgcactgcagagaccagcagggactaaagaagagaggacatggggaactggaaaaataagccttccaggattgtggggagaaagacgctgtgggagaggccaggatgctgcattaggcacaggataacctgggaacccaggcacatgggtcctgctctccgaagtctgcaagtcaagaagggaacagagcacgccgaccctctccctttcccctctgtctctcttagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgta

SEQ ID NO: 454901 - DNA, 2652 bp, Homo sapiens
gcacgagtttttctcaaatactcatgcattacttctataaataaaaagttttaaagtttgtttgcttttcactatccccatattggcattaaagagagccagtttatcaggcagcatttgaggtaaggaatgtccgtctctgggaccctatagatcctgggtaccagattacactcatctttctgacttaatttccagagtggatagcagcccctacctaagcacagccccctcattgggcaataagtcagcaacagcaatgctggccacacctcgtgccgaattcggcacgagagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccaggtgagttcaaccagcaaggccaggagggaggtgggaggaggtcagagggaaagggcatctgtgtggacagtcaccaggccctgctcccaacccctgcccttcttggcctcagccaagaaaaggagatacaggtatggttaacaaggaaaatgactcactgctccaaatcccagatgccttcaggtaatccctacccctatcttatcaatgcactcagaggtcctgcctttaactggcttctatgttgttctagcaccatcttctgcagagcccaaattgccctgcttcccctctctcctgcctctaccccttccccaaccaccaggtaggtacctagggtcctccggggaggaagggaggtgaccatggcccccagggataggagcagagagaagactgggatccagcatccatctggctacaactgaaatgctttccctcttccctgacttccctgggtaacccttagggaagggaacctatagaggtgggggtttcaggtatcagattgtccccttctgccttcccttttattcccaggttcaagggggcaggcacagggaagagagatttgatcatctagtcccggttttgcctggatgtgagatgggctcagggcagggagggggtgatgctgtcatccttctcggctggagcaggaagatgaaggacgatgtcagactcattttcagcctcattaggcagcagacggagatggagggaggagagcaggaggctgggggatgggctctgcactgcagagaccagcagggactaaagaagagaggacatggggaactggaaaaataagccttccaggattgtggggagaaagacgctgtgggagaggccaggatgctgcattaggcacaggataacctgggaacccaggcacatgggtcctgctctccgaagtctgcaagtcaagaagggaacagagcacgccgaccctctccctttcccctctgtctctcttagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgta

SEQ ID NO: 454902 - DNA, 3849 bp, Homo sapiens
cggagtgctgtttttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagcgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccaggtgagttcaaccagcaaggccaggagggaggtgggaggaggtcagagggaaagggcatctgtgtggacagtcaccaggccctgctcccaacccctgcccttcttggcctcagccaagaaaaggagatacaggtatggttaacaaggaaaatgactcactgctccaaatcccagatgccttcaggtaatccctacccctatcttatcaatgcactcagaggtcctgcctttaactggcttctatgttgttctagcaccatcttctgcagagcccaaattgccctgcttcccctctctcctgcctctaccccttccccaaccaccaggtaggtacctagggtcctccggggaggaagggaggtgaccatggcccccagggataggagcagagagaagactgggatccagcatccatctggctacaactgaaatgctttccctcttccctgacttccctgggtaacccttagggaagggaacctatagaggtgggggtttcaggtatcagattgtccccttctgccttcccttttattcccaggttcaagggggcaggcacagggaagagagatttgatcatctagtcccggttttgcctggatgtgagatgggctcagggcagggagggggtgatgctgtcatccttctcggctggagcaggaagatgaaggacgatgtcagactcattttcagcctcattaggcagcagacggagatggagggaggagagcaggaggctgggggatgggctctgcactgcagagaccagcagggactaaagaagagaggacatggggaactggaaaaataagccttccaggattgtggggagaaagacgctgtgggagaggccaggatgctgcattaggcacaggataacctgggaacccaggcacatgggtcctgctctccgaagtctgcaagtcaagaagggaacagagcacgccgaccctctccctttcccctctgtctctcttagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgta

SEQ ID NO: 454903 - DNA, 1481 bp, Homo sapiens
cggagtgctgtttttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggtgaggggagtccactgaccccgtcacttcctctcccttccatgacccccgcactccagccccctctctcaggcaagcagacctgctgtctgcctcacacgctttctctttccctctcaccctcactcaagctagttactggggatacccttttctgccgagctctctaccatctttccaaatgctattctgtattcctccacttcagaaataatcatagttaccacttattgtacagcaaaagctgagcaagagctaggagtggaggatttggaagaagagaatggatggaagtcagtgcaagataagagaggatggatttcagatgtggccacaggaaagataagattagactgtgttcttactattaagaaacattataactggtgatccaggaatgttatggaatctctgccctggaaaaaaaagatgcaaatcataaactcttagcactgggattgtaagatatgtatgagggtatgtaagaggtcaccctcaggaggcagcctctttaacatttgacagctgtcatttttgtatctcttgtattgagccaaactctcctctcctataacttaccagggggtcctgagacctctggagccacacagaataaatttctttcttcttccagaaaattg

SEQ ID NO: 454904 - DNA, 682 bp, Homo sapiens
cggagtgctgtttttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgatgttatcgcccaacacatgtatatacatacagcaaaattactgataactgaaggaagtttattgaagtacagagtaagcaggcccagtagtccataggaaccaggcagaaaacgttagcaagtagctgtaagactagggcatattgaagccctggagaacagagttgctttatttgttaactttttatcgaagtgcaaatatacaaaaatgtgcaagaaatagatcattaactccggactcctcgcactgtcccaagcttcttcccactact

SEQ ID NO: 454905 - DNA, 4074 bp, Homo sapiens
gaagtgacgcgccccgggtttgttgacagcggaggcggcggcggctgcaggctccgagccgtaggagccggatcgggggaggggccgggcccaggagcctcagccccgccggcagccctaagggcaaggcagtggctctgccaatgatcctgtgagtattcaggaatcactgttgcccctggggatccttgtcctggagtggcccacctgcttgcccccagcatggcgtccgacactcccgagtcgctgatggccctctgtactgacttctgcttgcgcaacctggatggcaccctgggctacctgctggacaaggagaccctgcggctacatccggacatcttcttgcccagcgagatctgtgaccggctcgtcaatgagtatgtggagctggtgaacgctgcctgtaacttcgagccacacgagagcttcttcagcctcttttcggacccccgcagcacccgcctcacgcggatccacctccgtgaggacctggtgcaggaccaggacctggaggccatccgcaagcaggacctggtggagctgtacctgactaactgcgagaagctgtccgccaagagcctgcagacactgaggagcttcagccacaccctggtgtccttgagcctcttcggctgtacaaacattttctatgaggaggagaacccagggggctgtgaagatgagtacctcgtcaaccccacctgccaggtgctggttaaggatttcaccttcgagggcttcagccgcctccgcttcctcaacttgggccgcatgattgattgggtccctgtggagtccctgctgcggccgcttaactccctggctgccttggacctctcaggcattcagacgagcgacgccgccttcctcacccagtggaaagacagcctggtgtccctcgtcctctacaacatggacctgtccgacgaccacatccgggtcatcgtgcagctgcacaagctgcgacacctggacatctcccgagaccgcctctccagctactacaagttcaagctgactcgggaggtgctgagcctctttgtgcagaagctggggaacctaatgtccctggacatctctggccacatgatcctagagaactgcagcatctccaagatggaagaggaagcggggcagaccagcattgagccttccaagagcagcatcatacctttccgggctctgaagaggccgctgcagttcctcgggctctttgagaactctctgtgccgcctcacgcacattccagcctacaaagtaagtggtgacaaaaacgaagagcaggtgctgaatgccatcgaggcctacacggagcaccggcctgagatcacctcgcgggccatcaacttgctttttgacatcgcccgcatcgagcgttgcaaccagctgctgcgggccctgaagctggtcatcacggccctcaagtgccacaaatatgacaggaacattcaagtgacaggcagcgccgctctcttctacctaacaaattccgagtaccgctcagagcagagtgtgaagctgcgccggcaggttatccaggtggtgctgaatggcatggaatcctaccaggaggtgacggtgcagcggaactgctgcctgacgctctgcaacttcagcatccccgaggagctggaattccagtaccgccgggtcaacgagctcctgctcagcatcctcaaccccacgcggcaggacgagtctatccagcggatcgccgtgcacctgtgcaatgccctggtctgccaggtagacaacgaccacaaggaggccgtgggcaagatgggctttgtcgtgaccatgctgaagctgattcagaagaagctgctggacaagacatgtgaccaggtcatggagttctcctggagtgccctgtggaacatcacagatgaaactcctgacaactgcgagatgttcctcaatttcaacggcatgaagctcttcctggactgcctgaaggaattcccagagaagcaggaactgcataggaatatgctaggacttttggggaatgtggcagaagtgaaggagctgaggcctcaactaatgacttcccagttcatcagcgtcttcagcaacctgttggagagcaaggccgatgggatcgaggtttcctacaatgcctgcggcgtcctctcccacatcatgtttgatggacccgaggcctggggcgtctgtgagccccagcgtgaggaggtggaggaacgcatgtgggctgccatccagagctgggacataaactctcggagaaacatcaattacaggtcatttgaaccaattctccgcctccttccccagggaatctctcctgtcagccagcactgggcaacctgggccctgtataacctcgtgtctgtctacccggacaagtactgccctctgctgatcaaagaaggggggatgccccttctgagggacataattaagatggcgaccgcacggcaggagaccaaggaaatggcccgcaaggtgattgagcactgcagtaactttaaagaggagaacatggacacgtctagatagaggcctccgtccccatggccgccaccgctctggaccacaggcggggaggaagcatgctcaagcagcccagcgggcgggccccttccgagggagcctcccacggagtgaagagacatgggggacttttgcacaaccgacgcttttccttaatgttagtgagatatatatatattatatatatatattttttttttggttaggaagtgtgaagttttgtgtgtatgatttctgtgcaaaaacaaaagcaacactcctgagtccttgcagcttccttggccattctcaaacccactcagccttcatcgctgacacacacactcctaccccaaccagactaaatgcctataacgctgtgagtgtccagtccttgtccaggaaactcagatcccggcctggcttcctttcatgagaggagcaggccttggacagcgtatcgagcatcctgacccactgcccctgcctgagaacgccatctcggctcccgggcacagctgatggggtttggggattagaacttaccccactgggtctcccaaaagccttggtgctcccggctgtgggccatctggggcaggaaagtgagccattcctaggctgaggtccaggcagccctgcccctgaagaccctctaggagcagggcacccagtggccctgctgctgtccagccaggcctgcctgaggccacgctgctatggaggctgcctcctagtctcccaccaggtcccaggctgtggaaagccccagcccagggatggtcagaactcgggggcagattccactgccccttctgccaaacacatccagaacctgccctcagccctggaagctagcatcttctggggccaggggcttgcttcctcgctccatagccctcaactgcccaggcgctcccaccagcagaactgagcctgcctcctcctcccagcctgccccgctgcccagaggaccccacgcctctcagaggcagaggtcccatgccagcctttgacccacaacggccacacagccgcctccagaccagcactcggactgccctgcagtggccgcttgggcctccctggcggtcccgccctgccctaggctttaccttggaagcctgagaggcgccggctctcttgctcctccatcgatggacactgcattgcttctcatcggacacttgtggagcgcaggggcctggggagcagcgctaaccctggaggcagcctttgggtgatggctttttcttcccttttcctcccgcgggcctgttttcaggtgttcctagcatttctgcctccaggcaggacggcaggggtgagcagctttgggagagacacctggcctttttctcctggagcctctccctcccggccctgggaagtgggcgcagccctgtgttcccccagcttggcagatgggctgcatgcggcgctcccttccttcccacgctcagcggccccggccagaccctggcagacttcacacctcattgctttaccccctggggcctggggaaatgtctgtactttgggaagtcacagaaatacatttttgtgcaaaatggaaaa

SEQ ID NO: 454906 - DNA, 4307 bp, Homo sapiens
gaagtgacgcgccccgggtttgttgacagcggaggcggcggcggctgcaggctccgagccgtaggagccggatcgggggaggggccgggcccaggagcctcagccccgccggcagccctaagggcaaggtaaccgccacggggtccccgtcgcgaccccctccctcccggagctcccgtccccgggatcccaagctccgccccgccgacccccgtctcccctggaccccggctctagcctgacgagatccccaacctcctgaggtgctctggccccggattctcccgggctgcattctctgctcctcctcgcctgcgaacatcacgtccgcttcccgacgctgagggcagccccgtccagggcagtggctctgccaatgatcctgtgagtattcaggaatcactgttgcccctggggatccttgtcctggagtggcccacctgcttgcccccagcatggcgtccgacactcccgagtcgctgatggccctctgtactgacttctgcttgcgcaacctggatggcaccctgggctacctgctggacaaggagaccctgcggctacatccggacatcttcttgcccagcgagatctgtgaccggctcgtcaatgagtatgtggagctggtgaacgctgcctgtaacttcgagccacacgagagcttcttcagcctcttttcggacccccgcagcacccgcctcacgcggatccacctccgtgaggacctggtgcaggaccaggacctggaggccatccgcaagcaggacctggtggagctgtacctgactaactgcgagaagctgtccgccaagagcctgcagacactgaggagcttcagccacaccctggtgtccttgagcctcttcggctgtacaaacattttctatgaggaggagaacccagggggctgtgaagatgagtacctcgtcaaccccacctgccaggtgctggttaaggatttcaccttcgagggcttcagccgcctccgcttcctcaacttgggccgcatgattgattgggtccctgtggagtccctgctgcggccgcttaactccctggctgccttggacctctcaggcattcagacgagcgacgccgccttcctcacccagtggaaagacagcctggtgtccctcgtcctctacaacatggacctgtccgacgaccacatccgggtcatcgtgcagctgcacaagctgcgacacctggacatctcccgagaccgcctctccagctactacaagttcaagctgactcgggaggtgctgagcctctttgtgcagaagctggggaacctaatgtccctggacatctctggccacatgatcctagagaactgcagcatctccaagatggaagaggaagcggggcagaccagcattgagccttccaagagcagcatcatacctttccgggctctgaagaggccgctgcagttcctcgggctctttgagaactctctgtgccgcctcacgcacattccagcctacaaagtaagtggtgacaaaaacgaagagcaggtgctgaatgccatcgaggcctacacggagcaccggcctgagatcacctcgcgggccatcaacttgctttttgacatcgcccgcatcgagcgttgcaaccagctgctgcgggccctgaagctggtcatcacggccctcaagtgccacaaatatgacaggaacattcaagtgacaggcagcgccgctctcttctacctaacaaattccgagtaccgctcagagcagagtgtgaagctgcgccggcaggttatccaggtggtgctgaatggcatggaatcctaccaggaggtgacggtgcagcggaactgctgcctgacgctctgcaacttcagcatccccgaggagctggaattccagtaccgccgggtcaacgagctcctgctcagcatcctcaaccccacgcggcaggacgagtctatccagcggatcgccgtgcacctgtgcaatgccctggtctgccaggtagacaacgaccacaaggaggccgtgggcaagatgggctttgtcgtgaccatgctgaagctgattcagaagaagctgctggacaagacatgtgaccaggtcatggagttctcctggagtgccctgtggaacatcacagatgaaactcctgacaactgcgagatgttcctcaatttcaacggcatgaagctcttcctggactgcctgaaggaattcccagagaagcaggaactgcataggaatatgctaggacttttggggaatgtggcagaagtgaaggagctgaggcctcaactaatgacttcccagttcatcagcgtcttcagcaacctgttggagagcaaggccgatgggatcgaggtttcctacaatgcctgcggcgtcctctcccacatcatgtttgatggacccgaggcctggggcgtctgtgagccccagcgtgaggaggtggaggaacgcatgtgggctgccatccagagctgggacataaactctcggagaaacatcaattacaggtcatttgaaccaattctccgcctccttccccagggaatctctcctgtcagccagcactgggcaacctgggccctgtataacctcgtgtctgtctacccggacaagtactgccctctgctgatcaaagaaggggggatgccccttctgagggacataattaagatggcgaccgcacggcaggagaccaaggaaatggcccgcaaggtgattgagcactgcagtaactttaaagaggagaacatggacacgtctagatagaggcctccgtccccatggccgccaccgctctggaccacaggcggggaggaagcatgctcaagcagcccagcgggcgggccccttccgagggagcctcccacggagtgaagagacatgggggacttttgcacaaccgacgcttttccttaatgttagtgagatatatatatattatatatatatattttttttttggttaggaagtgtgaagttttgtgtgtatgatttctgtgcaaaaacaaaagcaacactcctgagtccttgcagcttccttggccattctcaaacccactcagccttcatcgctgacacacacactcctaccccaaccagactaaatgcctataacgctgtgagtgtccagtccttgtccaggaaactcagatcccggcctggcttcctttcatgagaggagcaggccttggacagcgtatcgagcatcctgacccactgcccctgcctgagaacgccatctcggctcccgggcacagctgatggggtttggggattagaacttaccccactgggtctcccaaaagccttggtgctcccggctgtgggccatctggggcaggaaagtgagccattcctaggctgaggtccaggcagccctgcccctgaagaccctctaggagcagggcacccagtggccctgctgctgtccagccaggcctgcctgaggccacgctgctatggaggctgcctcctagtctcccaccaggtcccaggctgtggaaagccccagcccagggatggtcagaactcgggggcagattccactgccccttctgccaaacacatccagaacctgccctcagccctggaagctagcatcttctggggccaggggcttgcttcctcgctccatagccctcaactgcccaggcgctcccaccagcagaactgagcctgcctcctcctcccagcctgccccgctgcccagaggaccccacgcctctcagaggcagaggtcccatgccagcctttgacccacaacggccacacagccgcctccagaccagcactcggactgccctgcagtggccgcttgggcctccctggcggtcccgccctgccctaggctttaccttggaagcctgagaggcgccggctctcttgctcctccatcgatggacactgcattgcttctcatcggacacttgtggagcgcaggggcctggggagcagcgctaaccctggaggcagcctttgggtgatggctttttcttcccttttcctcccgcgggcctgttttcaggtgttcctagcatttctgcctccaggcaggacggcaggggtgagcagctttgggagagacacctggcctttttctcctggagcctctccctcccggccctgggaagtgggcgcagccctgtgttcccccagcttggcagatgggctgcatgcggcgctcccttccttcccacgctcagcggccccggccagaccctggcagacttcacacctcattgctttaccccctggggcctggggaaatgtctgtactttgggaagtcacagaaatacatttttgtgcaaaatggaaaa

SEQ ID NO: 454907 - DNA, 4263 bp, Homo sapiens
gaagtgacgcgccccgggtttgttgacagcggaggcggcggcggctgcaggctccgagccgtaggagccggatcgggggaggggccgggcccaggagcctcagccccgccggcagccctaagggcaaggcagtggctctgccaatgatcctgtgagtattcaggaatcactgttgcccctggggatccttgtcctggagtggcccacctgcttgcccccagcatggcgtccgacactcccgagtcgctgatggccctctgtactgacttctgcttgcgcaacctggatggcaccctgggctacctgctggacaaggagaccctgcggctacatccggacatcttcttgcccagcgagatctgtgaccggctcgtcaatgagtatgtggagctggtgaacgctgcctgtaacttcgagccacacgagagcttcttcagcctcttttcggacccccgcagcacccgcctcacgcggatccacctccgtgaggacctggtgcaggaccaggacctggaggccatccgcaagcaggacctggtggagctgtacctgactaactgcgagaagctgtccgccaagagcctgcagacactgaggagcttcagccacaccctggtgtccttgagcctcttcggctgtacaaacattttctatgaggaggagaacccagggggctgtgaagatgagtacctcgtcaaccccacctgccaggtgctggttaaggatttcaccttcgagggcttcagccgcctccgcttcctcaacttgggccgcatgattgattgggtccctgtggagtccctgctgcggccgcttaactccctggctgccttggacctctcaggcattcagacgagcgacgccgccttcctcacccagtggaaagacagcctggtgtccctcgtcctctacaacatggacctgtccgacgaccacatccgggtcatcgtgcagctgcacaagctgcgacacctggacatctcccgagaccgcctctccagctactacaagttcaagctgactcgggaggtgctgagcctctttgtgcagaagctggggaacctaatgtccctggacatctctggccacatgatcctagagaactgcagcatctccaagatggaagaggaagcggggcagaccagcattgagccttccaagagcagcatcatacctttccgggctctgaagaggccgctgcagttcctcgggctctttgagaactctctgtgccgcctcacgcacattccagcctacaaagtaagtggtgacaaaaacgaagagcaggtgctgaatgccatcgaggcctacacggagcaccggcctgagatcacctcgcgggccatcaacttgctttttgacatcgcccgcatcgagcgttgcaaccagctgctgcgggccctgaagctggtcatcacggccctcaagtgccacaaatatgacaggaacattcaagtgacaggcagcgccgctctcttctacctaacaaattccgagtaccgctcagagcagagtgtgaagctgcgccggcaggttatccaggtggtgctgaatggcatggaatcctaccaggaggtgacggtgcagcggaactgctgcctgacgctctgcaacttcagcatccccgaggagctggaattccagtaccgccgggtcaacgagctcctgctcagcatcctcaaccccacgcggcaggacgagtctatccagcggatcgccgtgcacctgtgcaatgccctggtctgccaggtagacaacgaccacaaggaggccgtgggcaagatgggctttgtcgtgaccatgctgaagctgattcagaagaagctgctggacaagacatgtgaccaggtcatggagttctcctggagtgccctgtggaacatcacagatgaaactcctgacaactgcgagatgttcctcaatttcaacggcatgaagctcttcctggactgcctgaaggaattcccagagaagcaggaactgcataggaatatgctaggacttttggggaatgtggcagaagtgaaggagctgaggcctcaactaatgacttcccagttcatcagcgtcttcagcaacctgttggagagcaaggccgatgggatcgaggtttcctacaatgcctgcggcgtcctctcccacatcatgtttgatggacccgaggcctggggcgtctgtgagccccagcgtgaggaggtggaggaacgcatgtgggctgccatccagagctgggacataaactctcggagaaacatcaattacaggtcatttgaaccaattctccgcctccttccccagggaatctctcctgtcagccagcactgggcaacctgggccctgtataacctcgtgtctgtctacccggacaagtactgccctctgctgatcaaagaaggggggatgccccttctgagggacataattaagatggcgaccgcacggcaggagaccaaggaaatggcccgcaaggtgattgagcactgcagtaactttaaagaggagaacatggacacgtctagatagaggcctccgtccccatggccgccaccgctctggaccacaggcggggaggaagcatgctcaagcagcccagcgggcgggccccttccgagggagcctcccacggagtgaagagacatgggggacttttgcacaaccgacgcttttccttaatgttagtgagatatatatatattatatatatatattttttttttggttaggaagtgtgaagttttgtgtgtatgatttctgtgcaaaaacaaaagcaacactcctgagtccttgcagcttccttggccattctcaaacccactcagccttcatcgctgacacacacactcctaccccaaccagactaaatgcctataacgctgtgagtgtccagtccttgtccaggaaactcagatcccggcctggcttcctttcatgagaggagcaggccttggacagcgtatcgagcatcctgacccactgcccctgcctgagaacgccatctcggctcccgggcacagctgatggggtttggggattagaacttaccccactgggtctcccaaaagccttggtgctcccggctgtgggccatctggggcaggaaagtgagccattcctaggctgaggtccaggcagccctgcccctgaagaccctctaggagcagggcacccagtggccctgctgctgtccagccaggcctgcctgaggccacgctgctatggaggctgcctcctagtctcccaccaggtcccaggctgtggaaagccccagcccagggatggtcagaactcgggggcagattccactgccccttctgccaaacacatccagaacctgccctcagccctggaagctagcatcttctggggccaggggcttgcttcctcgctccatagccctcaactgcccaggcgctcccaccagcagaactgagcctgcctcctcctcccagcctgccccgctgcccagaggaccccacgcctctcagaggcagaggtcccatgccagcctttgacccacaacggccacacagccgcctccagaccagcactcggactgccctgcagtggccgcttgggcctccctggcggtcccgccctgccctaggctttaccttggaagcctgagaggcgccggctctcttgctcctccatcgatggacactgcattgcttctcatcggacacttgtggagcgcaggggcctggggagcagcgctaaccctggaggcagcctttgggtgatggctttttcttcccttttcctcccgcgggcctgttttcaggtgttcctagcatttctgcctccaggcaggacggcaggggtgagcagctttgggagagacacctggcctttttctcctggagcctctccctcccggccctgggaagtgggcgcagccctgtgttcccccagcttggcagatgggctgcatgcggcgctcccttccttcccacgctcagcggccccggccagaccctggcagacttcacacctcattgctttaccccctggggcctggggaaatgtctgtactttgggaagtcacagaaatacatttttgtgcaaaatggaaaaaaaaaaaaaaaaaaaaaacacaacccacacacacaacaccccaggcgcacacaacaaaaacagcgatagccacgaacacaacgaataaaaagaaggacgccaccaagagctaccaaaaacaggacacgataccgcccacgatgaccaggagacaacacgggcggaaaaaacatcggcaagaaccccaac

SEQ ID NO: 454908 - DNA, 4055 bp, Homo sapiens
gaagtgacgcgccccgggtttgttgacagcggaggcggcggcggctgcaggctccgagccgtaggagccggatcgggggaggggccgggcccaggagcctcagccccgccggcagccctaagggcaaggtaaccgccacggggtccccgtcgcgaccccctccctcccggagctcccgtccccgggatcccaagctccgccccgccgacccccgtctcccctggaccccggctctagcctgacgagatccccaacctcctgaggtgctctggccccggattctcccgggctgcattctctgctcctcctcgcctgcgaacatcacgtccgcttcccgacgctgagggcagccccgtccagggtatgtggagctggtgaacgctgcctgtaacttcgagccacacgagagcttcttcagcctcttttcggacccccgcagcacccgcctcacgcggatccacctccgtgaggacctggtgcaggaccaggacctggaggccatccgcaagcaggacctggtggagctgtacctgactaactgcgagaagctgtccgccaagagcctgcagacactgaggagcttcagccacaccctggtgtccttgagcctcttcggctgtacaaacattttctatgaggaggagaacccagggggctgtgaagatgagtacctcgtcaaccccacctgccaggtgctggttaaggatttcaccttcgagggcttcagccgcctccgcttcctcaacttgggccgcatgattgattgggtccctgtggagtccctgctgcggccgcttaactccctggctgccttggacctctcaggcattcagacgagcgacgccgccttcctcacccagtggaaagacagcctggtgtccctcgtcctctacaacatggacctgtccgacgaccacatccgggtcatcgtgcagctgcacaagctgcgacacctggacatctcccgagaccgcctctccagctactacaagttcaagctgactcgggaggtgctgagcctctttgtgcagaagctggggaacctaatgtccctggacatctctggccacatgatcctagagaactgcagcatctccaagatggaagaggaagcggggcagaccagcattgagccttccaagagcagcatcatacctttccgggctctgaagaggccgctgcagttcctcgggctctttgagaactctctgtgccgcctcacgcacattccagcctacaaagtaagtggtgacaaaaacgaagagcaggtgctgaatgccatcgaggcctacacggagcaccggcctgagatcacctcgcgggccatcaacttgctttttgacatcgcccgcatcgagcgttgcaaccagctgctgcgggccctgaagctggtcatcacggccctcaagtgccacaaatatgacaggaacattcaagtgacaggcagcgccgctctcttctacctaacaaattccgagtaccgctcagagcagagtgtgaagctgcgccggcaggttatccaggtggtgctgaatggcatggaatcctaccaggaggtgacggtgcagcggaactgctgcctgacgctctgcaacttcagcatccccgaggagctggaattccagtaccgccgggtcaacgagctcctgctcagcatcctcaaccccacgcggcaggacgagtctatccagcggatcgccgtgcacctgtgcaatgccctggtctgccaggtagacaacgaccacaaggaggccgtgggcaagatgggctttgtcgtgaccatgctgaagctgattcagaagaagctgctggacaagacatgtgaccaggtcatggagttctcctggagtgccctgtggaacatcacagatgaaactcctgacaactgcgagatgttcctcaatttcaacggcatgaagctcttcctggactgcctgaaggaattcccagagaagcaggaactgcataggaatatgctaggacttttggggaatgtggcagaagtgaaggagctgaggcctcaactaatgacttcccagttcatcagcgtcttcagcaacctgttggagagcaaggccgatgggatcgaggtttcctacaatgcctgcggcgtcctctcccacatcatgtttgatggacccgaggcctggggcgtctgtgagccccagcgtgaggaggtggaggaacgcatgtgggctgccatccagagctgggacataaactctcggagaaacatcaattacaggtcatttgaaccaattctccgcctccttccccagggaatctctcctgtcagccagcactgggcaacctgggccctgtataacctcgtgtctgtctacccggacaagtactgccctctgctgatcaaagaaggggggatgccccttctgagggacataattaagatggcgaccgcacggcaggagaccaaggaaatggcccgcaaggtgattgagcactgcagtaactttaaagaggagaacatggacacgtctagatagaggcctccgtccccatggccgccaccgctctggaccacaggcggggaggaagcatgctcaagcagcccagcgggcgggccccttccgagggagcctcccacggagtgaagagacatgggggacttttgcacaaccgacgcttttccttaatgttagtgagatatatatatattatatatatatattttttttttggttaggaagtgtgaagttttgtgtgtatgatttctgtgcaaaaacaaaagcaacactcctgagtccttgcagcttccttggccattctcaaacccactcagccttcatcgctgacacacacactcctaccccaaccagactaaatgcctataacgctgtgagtgtccagtccttgtccaggaaactcagatcccggcctggcttcctttcatgagaggagcaggccttggacagcgtatcgagcatcctgacccactgcccctgcctgagaacgccatctcggctcccgggcacagctgatggggtttggggattagaacttaccccactgggtctcccaaaagccttggtgctcccggctgtgggccatctggggcaggaaagtgagccattcctaggctgaggtccaggcagccctgcccctgaagaccctctaggagcagggcacccagtggccctgctgctgtccagccaggcctgcctgaggccacgctgctatggaggctgcctcctagtctcccaccaggtcccaggctgtggaaagccccagcccagggatggtcagaactcgggggcagattccactgccccttctgccaaacacatccagaacctgccctcagccctggaagctagcatcttctggggccaggggcttgcttcctcgctccatagccctcaactgcccaggcgctcccaccagcagaactgagcctgcctcctcctcccagcctgccccgctgcccagaggaccccacgcctctcagaggcagaggtcccatgccagcctttgacccacaacggccacacagccgcctccagaccagcactcggactgccctgcagtggccgcttgggcctccctggcggtcccgccctgccctaggctttaccttggaagcctgagaggcgccggctctcttgctcctccatcgatggacactgcattgcttctcatcggacacttgtggagcgcaggggcctggggagcagcgctaaccctggaggcagcctttgggtgatggctttttcttcccttttcctcccgcgggcctgttttcaggtgttcctagcatttctgcctccaggcaggacggcaggggtgagcagctttgggagagacacctggcctttttctcctggagcctctccctcccggccctgggaagtgggcgcagccctgtgttcccccagcttggcagatgggctgcatgcggcgctcccttccttcccacgctcagcggccccggccagaccctggcagacttcacacctcattgctttaccccctggggcctggggaaatgtctgtactttgggaagtcacagaaatacatttttgtgcaaaatggaaaa

SEQ ID NO: 454909 - DNA, 2982 bp, Homo sapiens
gaagtgacgcgccccgggtttgttgacagcggaggcggcggcggctgcaggctccgagccgtaggagccggatcgggggaggggccgggcccaggagcctcagccccgccggcagccctaagggcaaggcagtggctctgccaatgatcctgtgagtattcaggaatcactgttgcccctggggatccttgtcctggagtggcccacctgcttgcccccagcatggcgtccgacactcccgagtcgctgatggccctctgtactgacttctgcttgcgcaacctggatggcaccctgggctacctgctggacaaggagaccctgcggctacatccggacatcttcttgcccagcgagatctgtgaccggctcgtcaatgagtatgtggagctggtgaacgctgcctgtaacttcgagccacacgagagcttcttcagcctcttttcggacccccgcagcacccgcctcacgcggatccacctccgtgaggacctggtgcaggaccaggacctggaggccatccgcaagcaggacctggtggagctgtacctgactaactgcgagaagctgtccgccaagagcctgcagacactgaggagcttcagccacaccctggtgtccttgagcctcttcggctgtacaaacattttctatgaggaggagaacccagggggctgtgaagatgagtacctcgtcaaccccacctgccaggtgctggttaaggatttcaccttcgagggcttcagccgcctccgcttcctcaacttgggccgcatgattgattgggtccctgtggagtccctgctgcggccgcttaactccctggctgccttggacctctcaggcattcagacgagcgacgccgccttcctcacccagtggaaagacagcctggtgtccctcgtcctctacaacatggacctgtccgacgaccacatccgggtcatcgtgcagctgcacaagctgcgacacctggacatctcccgagaccgcctctccagctactacaagttcaagctgactcgggaggtgctgagcctctttgtgcagaagctggggaacctaatgtccctggacatctctggccacatgatcctagagaactgcagcatctccaagatggaagaggaagcggggcagaccagcattgagccttccaagagcagcatcatacctttccgggctctgaagaggccgctgcagttcctcgggctctttgagaactctctgtgccgcctcacgcacattccagcctacaaagtaagtggtgacaaaaacgaagagcaggtgctgaatgccatcgaggcctacacggagcaccggcctgagatcacctcgcgggccatcaacttgctttttgacatcgcccgcatcgagcgttgcaaccagctgctgcgggccctgaagctggtcatcacggccctcaagtgccacaaatatgacaggaacattcaagtgacaggcagcgccgctctcttctacctaacaaattccgagtaccgctcagagcagagtgtgaagctgcgccggcaggttatccaggtggtgctgaatggcatggaatcctaccaggaggtgacggtgcagcggaactgctgcctgacgctctgcaacttcagcatccccgaggagctggaattccagtaccgccgggtcaacgagctcctgctcagcatcctcaaccccacgcggcaggacgagtctatccagcggatcgccgtgcacctgtgcaatgccctggtctgccaggtagacaacgaccacaaggaggccgtgggcaagatgggctttgtcgtgaccatgctgaagctgattcagaagaagctgctggacaagacatgtgaccaggtcatggagttctcctggagtgccctgtggaacatcacagatgaaactcctgacaactgcgagatgttcctcaatttcaacggcatgaagctcttcctggactgcctgaaggaattcccagagaagcaggaactgcataggaatatgctaggacttttggggaatgtggcagaagtgaaggagctgaggcctcaactaatgacttcccagttcatcagcgtcttcagcaacctgttggagagcaaggccgatgggatcgaggtttcctacaatgcctgcggcgtcctctcccacatcatgtttgatggacccgaggcctggggcgtctgtgagccccagcgtgaggaggtggaggaacgcatgtgggctgccatccagagctgggacataaactctcggagaaacatcaattacaggtcatttgaaccaattctccgcctccttccccagggaatctctcctgtcagccagcactgggcaacctgggccctgtataacctcgtgtctgtctacccggacaagtactgccctctgctgatcaaagaaggggggatgccccttctgagggacataattaagatggcgaccgcacggcaggagaccaaggaaatggcccgcaaggtgattgagcactgcagtaactttaaagaggagaacatggacacgtctagatagaggcctccgtccccatggccgccaccgctctggaccacaggcggggaggaagcatgctcaagcagcccagcgggcgggccccttccgagggagcctcccacggagtgaagagacatgggggacttttgcacaaccgacgcttttcctcccgcgggcctgttttcaggtgttcctagcatttctgcctccaggcaggacggcaggggtgagcagctttgggagagacacctggcctttttctcctggagcctctccctcccggccctgggaagtgggcgcagccctgtgttcccccagcttggcagatgggctgcatgcggcgctcccttccttcccacgctcagcggccccggccagaccctggcagacttcacacctcattgctttaccccctggggcctggggaaatgtctgtactttgggaagtcacagaaatacatttttgtgcaaaatggaaaa

SEQ ID NO: 454910 - DNA, 2549 bp, Homo sapiens
ctagaggatccccacgggcgatccgctggatagactcgtcctgccgcgtggggtgagggatgctgagcaggagctcgttgacccggcggtactggaattccagctcctcggggatgctgaagttgcagagcgtcaggcagcagttccgctgcaccgtcacctcctggtaggacgagtctatccagcggatcgccgtgcacctgtgcaatgccctggtctgccaggtagacaacgaccacaaggaggccgtgggcaagatgggctttgtcgtgaccatgctgaagctgattcagaagaagctgctggacaagacatgtgaccaggtcatggagttctcctggagtgccctgtggaacatcacagatgaaactcctgacaactgcgagatgttcctcaatttcaacggcatgaagctcttcctggactgcctgaaggaattcccagagaagcaggaactgcataggaatatgctaggacttttggggaatgtggcagaagtgaaggagctgaggcctcaactaatgacttcccagttcatcagcgtcttcagcaacctgttggagagcaaggccgatgggatcgaggtttcctacaatgcctgcggcgtcctctcccacatcatgtttgatggacccgaggcctggggcgtctgtgagccccagcgtgaggaggtggaggaacgcatgtgggctgccatccagagctgggacataaactctcggagaaacatcaattacaggtcatttgaaccaattctccgcctccttccccagggaatctctcctgtcagccagcactgggcaacctgggccctgtataacctcgtgtctgtctacccggacaagtactgccctctgctgatcaaagaaggggggatgccccttctgagggacataattaagatggcgaccgcacggcaggagaccaaggaaatggcccgcaaggtgattgagcactgcagtaactttaaagaggagaacatggacacgtctagatagaggcctccgtccccatggccgccaccgctctggaccacaggcggggaggaagcatgctcaagcagcccagcgggcgggccccttccgagggagcctcccacggagtgaagagacatgggggacttttgcacaaccgacgcttttccttaatgttagtgagatatatatatattatatatatatattttttttttggttaggaagtgtgaagttttgtgtgtatgatttctgtgcaaaaacaaaagcaacactcctgagtccttgcagcttccttggccattctcaaacccactcagccttcatcgctgacacacacactcctaccccaaccagactaaatgcctataacgctgtgagtgtccagtccttgtccaggaaactcagatcccggcctggcttcctttcatgagaggagcaggccttggacagcgtatcgagcatcctgacccactgcccctgcctgagaacgccatctcggctcccgggcacagctgatggggtttggggattagaacttaccccactgggtctcccaaaagccttggtgctcccggctgtgggccatctggggcaggaaagtgagccattcctaggctgaggtccaggcagccctgcccctgaagaccctctaggagcagggcacccagtggccctgctgctgtccagccaggcctgcctgaggccacgctgctatggaggctgcctcctagtctcccaccaggtcccaggctgtggaaagccccagcccagggatggtcagaactcgggggcagattccactgccccttctgccaaacacatccagaacctgccctcagccctggaagctagcatcttctggggccaggggcttgcttcctcgctccatagccctcaactgcccaggcgctcccaccagcagaactgagcctgcctcctcctcccagcctgccccgctgcccagaggaccccacgcctctcagaggcagaggtcccatgccagcctttgacccacaacggccacacagccgcctccagaccagcactcggactgccctgcagtggccgcttgggcctccctggcggtcccgccctgccctaggctttaccttggaagcctgagaggcgccggctctcttgctcctccatcgatggacactgcattgcttctcatcggacacttgtggagcgcaggggcctggggagcagcgctaaccctggaggcagcctttgggtgatggctttttcttcccttttcctcccgcgggcctgttttcaggtgttcctagcatttctgcctccaggcaggacggcaggggtgagcagctttgggagagacacctggcctttttctcctggagcctctccctcccggccctgggaagtgggcgcagccctgtgttcccccagcttggcagatgggctgcatgcggcgctcccttccttcccacgctcagcggccccggccagaccctggcagacttcacacctcattgctttaccccctggggcctggggaaatgtctgtactttgggaagtcacagaaatacatttttgtgcaaaatggaaaa

SEQ ID NO: 454911 - DNA, 2154 bp, Homo sapiens
acatatcaacggcacaaggccggaattggactgccggaggaattcccagagaagcaggaactgcataggaatatgctaggacttttggggaatgtggcagaagtgaaggagctgaggcctcaactaatgacttcccagttcatcagcgtcttcagcaacctgttggagagcaaggccgatgggatcgaggtttcctacaatgcctgcggcgtcctctcccacatcatgtttgatggacccgaggcctggggcgtctgtgagccccagcgtgaggaggtggaggaacgcatgtgggctgccatccagagctgggacataaactctcggagaaacatcaattacaggtcatttgaaccaattctccgcctccttccccagggaatctctcctgtcagccagcactgggcaacctgggccctgtataacctcgtgtctgtctacccggacaagtactgccctctgctgatcaaagaaggggggatgccccttctgagggacataattaagatggcgaccgcacggcaggagaccaaggaaatggcccgcaaggtgattgagcactgcagtaactttaaagaggagaacatggacacgtctagatagaggcctccgtccccatggccgccaccgctctggaccacaggcggggaggaagcatgctcaagcagcccagcgggcgggccccttccgagggagcctcccacggagtgaagagacatgggggacttttgcacaaccgacgcttttccttaatgttagtgagatatatatatattatatatatatattttttttttggttaggaagtgtgaagttttgtgtgtatgatttctgtgcaaaaacaaaagcaacactcctgagtccttgcagcttccttggccattctcaaacccactcagccttcatcgctgacacacacactcctaccccaaccagactaaatgcctataacgctgtgagtgtccagtccttgtccaggaaactcagatcccggcctggcttcctttcatgagaggagcaggccttggacagcgtatcgagcatcctgacccactgcccctgcctgagaacgccatctcggctcccgggcacagctgatggggtttggggattagaacttaccccactgggtctcccaaaagccttggtgctcccggctgtgggccatctggggcaggaaagtgagccattcctaggctgaggtccaggcagccctgcccctgaagaccctctaggagcagggcacccagtggccctgctgctgtccagccaggcctgcctgaggccacgctgctatggaggctgcctcctagtctcccaccaggtcccaggctgtggaaagccccagcccagggatggtcagaactcgggggcagattccactgccccttctgccaaacacatccagaacctgccctcagccctggaagctagcatcttctggggccaggggcttgcttcctcgctccatagccctcaactgcccaggcgctcccaccagcagaactgagcctgcctcctcctcccagcctgccccgctgcccagaggaccccacgcctctcagaggcagaggtcccatgccagcctttgacccacaacggccacacagccgcctccagaccagcactcggactgccctgcagtggccgcttgggcctccctggcggtcccgccctgccctaggctttaccttggaagcctgagaggcgccggctctcttgctcctccatcgatggacactgcattgcttctcatcggacacttgtggagcgcaggggcctggggagcagcgctaaccctggaggcagcctttgggtgatggctttttcttcccttttcctcccgcgggcctgttttcaggtgttcctagcatttctgcctccaggcaggacggcaggggtgagcagctttgggagagacacctggcctttttctcctggagcctctccctcccggccctgggaagtgggcgcagccctgtgttcccccagcttggcagatgggctgcatgcggcgctcccttccttcccacgctcagcggccccggccagaccctggcagacttcacacctcattgctttaccccctggggcctggggaaatgtctgtactttgggaagtcacagaaatacatttttgtgcaaaatggaaaa

SEQ ID NO: 454912 - DNA, 2143 bp, Homo sapiens
cgaaaaattatggcttaggtacgaggctgggtggtttaatcggccggaactgcataggaatatgctaggacttttggggaatgtggcagaagtgaaggagctgaggcctcaactaatgacttcccagttcatcagcgtcttcagcaacctgttggagagcaaggccgatgggatcgaggtttcctacaatgcctgcggcgtcctctcccacatcatgtttgatggacccgaggcctggggcgtctgtgagccccagcgtgaggaggtggaggaacgcatgtgggctgccatccagagctgggacataaactctcggagaaacatcaattacaggtcatttgaaccaattctccgcctccttccccagggaatctctcctgtcagccagcactgggcaacctgggccctgtataacctcgtgtctgtctacccggacaagtactgccctctgctgatcaaagaaggggggatgccccttctgagggacataattaagatggcgaccgcacggcaggagaccaaggaaatggcccgcaaggtgattgagcactgcagtaactttaaagaggagaacatggacacgtctagatagaggcctccgtccccatggccgccaccgctctggaccacaggcggggaggaagcatgctcaagcagcccagcgggcgggccccttccgagggagcctcccacggagtgaagagacatgggggacttttgcacaaccgacgcttttccttaatgttagtgagatatatatatattatatatatatattttttttttggttaggaagtgtgaagttttgtgtgtatgatttctgtgcaaaaacaaaagcaacactcctgagtccttgcagcttccttggccattctcaaacccactcagccttcatcgctgacacacacactcctaccccaaccagactaaatgcctataacgctgtgagtgtccagtccttgtccaggaaactcagatcccggcctggcttcctttcatgagaggagcaggccttggacagcgtatcgagcatcctgacccactgcccctgcctgagaacgccatctcggctcccgggcacagctgatggggtttggggattagaacttaccccactgggtctcccaaaagccttggtgctcccggctgtgggccatctggggcaggaaagtgagccattcctaggctgaggtccaggcagccctgcccctgaagaccctctaggagcagggcacccagtggccctgctgctgtccagccaggcctgcctgaggccacgctgctatggaggctgcctcctagtctcccaccaggtcccaggctgtggaaagccccagcccagggatggtcagaactcgggggcagattccactgccccttctgccaaacacatccagaacctgccctcagccctggaagctagcatcttctggggccaggggcttgcttcctcgctccatagccctcaactgcccaggcgctcccaccagcagaactgagcctgcctcctcctcccagcctgccccgctgcccagaggaccccacgcctctcagaggcagaggtcccatgccagcctttgacccacaacggccacacagccgcctccagaccagcactcggactgccctgcagtggccgcttgggcctccctggcggtcccgccctgccctaggctttaccttggaagcctgagaggcgccggctctcttgctcctccatcgatggacactgcattgcttctcatcggacacttgtggagcgcaggggcctggggagcagcgctaaccctggaggcagcctttgggtgatggctttttcttcccttttcctcccgcgggcctgttttcaggtgttcctagcatttctgcctccaggcaggacggcaggggtgagcagctttgggagagacacctggcctttttctcctggagcctctccctcccggccctgggaagtgggcgcagccctgtgttcccccagcttggcagatgggctgcatgcggcgctcccttccttcccacgctcagcggccccggccagaccctggcagacttcacacctcattgctttaccccctggggcctggggaaatgtctgtactttgggaagtcacagaaatacatttttgtgcaaaatggaaaa

SEQ ID NO: 454913 - DNA, 1056 bp, Homo sapiens
actactaagcgcgcgccccgtcgacccactgggtctcccaaaagccttggtgctcccggctgtgggccatctggggcaggaaagtgagccattcctaggctgaggtccaggcagccctgcccctgaagaccctctaggagcagggcacccagtggccctgctgctgtccagccaggcctgcctgaggccacgctgctatggaggctgcctcctagtctcccaccaggtcccaggctgtggaaagccccagcccagggatggtcagaactcgggggcagattccactgccccttctgccaaacacatccagaacctgccctcagccctggaagctagcatcttctggggccaggggcttgcttcctcgctccatagccctcaactgcccaggcgctcccaccagcagaactgagcctgcctcctcctcccagcctgccccgctgcccagaggaccccacgcctctcagaggcagaggtcccatgccagcctttgacccacaacggccacacagccgcctccagaccagcactcggactgccctgcagtggccgcttgggcctccctggcggtcccgccctgccctaggctttaccttggaagcctgagaggcgccggctctcttgctcctccatcgatggacactgcattgcttctcatcggacacttgtggagcgcaggggcctggggagcagcgctaaccctggaggcagcctttgggtgatggctttttcttcccttttcctcccgcgggcctgttttcaggtgttcctagcatttctgcctccaggcaggacggcaggggtgagcagctttgggagagacacctggcctttttctcctggagcctctccctcccggccctgggaagtgggcgcagccctgtgttcccccagcttggcagatgggctgcatgcggcgctcccttccttcccacgctcagcggccccggccagaccctggcagacttcacacctcattgctttaccccctggggcctggggaaatgtctgtactttgggaagtcacagaaatacatttttgtgcaaaatggaaaa

SEQ ID NO: 454914 - DNA, 214 bp, Homo sapiens
aaaactatacatttgtgttttatgcattcttctgtatgaatatttcacatttttaaaaaacattttttagagaagacttgtatagcctcctcttccagaaaaccgggctggactgccacaactctggatgagctcatacctctagatagttcctagagccctgctcctgagtctgaccctgaatgtgccccacttgtgtcctgtcccggcccag

SEQ ID NO: 454915 - DNA, 422 bp, Homo sapiens
gtgggggtgggagttcttcagccccagcactctagcagactcttgtccctgcctgcagaccatgctgaagctgattcagaagaagctgctggacaagacagtaagtcaagtcttcacgaagccacgctaccctttccccacctcgcaaggggcctgggctgcccctgggggaggtctgtgttttgtcaggggcccccctccccgggtaccaggagccttggctgagccctgccctgccctcacagtgtgaccaggtcatggagttctcctggagtgccctgtggaacatcacagatgaaactcctgacaactgcgagatgttcctcaatttcaacggcatgaagctcttcctggactgcctgaaggtagtgtccacctcctgcagcagcagctgcctcagctgcccacatggcccctcttct

SEQ ID NO: 454916 - DNA, 468 bp, Homo sapiens
gggggaggtctgtgttttgtcaggggcccccctccccgggtaccaggagccttggctgagccctgccctgccctcacagtgtgaccaggtcatggagttctcctggagtgccctgtggaacatcacagatgaaactcctgacaactgcgagatgttcctcaatttcaacggcatgaagctcttcctggactgcctgaaggtagtgtccacctcctgcagcagcagctgcctcagctgcccacatggcccctcttctgtccctaggctccccaccaaccaaatccgcagcacccctcacccatgcttcctggagaagggcagtggggacagactcaggcccacccacccaggatttgctgctgacagaagctccagacccagatggcctggtggggcctcctgagagcccccactcccagggaaagcccctccctgtctcctcggccgttgttctcaggctgcccacag

SEQ ID NO: 454917 - DNA, 4042 bp, Homo sapiens
cttggattctggatcagctcccaaaagggatgacacaaagtatagggaaatccaacagggtgaggttgcaaccggagggccaagggagcccgacaggcagtggctctgccaatgatcctgtgagtattcaggaatcactgttgcccctggggatccttgtcctggagtggcccacctgcttgcccccagcatggcgtccgacactcccgagtcgctgatggccctctgtactgacttctgcttgcgcaacctggatggcaccctgggctacctgctggacaaggagaccctgcggctacatccggacatcttcttgcccagcgagatctgtgaccggctcgtcaatgagtatgtggagctggtgaacgctgcctgtaacttcgagccacacgagagcttcttcagcctcttttcggacccccgcagcacccgcctcacgcggatccacctccgtgaggacctggtgcaggaccaggacctggaggccatccgcaagcaggacctggtggagctgtacctgactaactgcgagaagctgtccgccaagagcctgcagacactgaggagcttcagccacaccctggtgtccttgagcctcttcggctgtacaaacattttctatgaggaggagaacccagggggctgtgaagatgagtacctcgtcaaccccacctgccaggtgctggttaaggatttcaccttcgagggcttcagccgcctccgcttcctcaacttgggccgcatgattgattgggtccctgtggagtccctgctgcggccgcttaactccctggctgccttggacctctcaggcattcagacgagcgacgccgccttcctcacccagtggaaagacagcctggtgtccctcgtcctctacaacatggacctgtccgacgaccacatccgggtcatcgtgcagctgcacaagctgcgacacctggacatctcccgagaccgcctctccagctactacaagttcaagctgactcgggaggtgctgagcctctttgtgcagaagctggggaacctaatgtccctggacatctctggccacatgatcctagagaactgcagcatctccaagatggaagaggaagcggggcagaccagcattgagccttccaagagcagcatcatacctttccgggctctgaagaggccgctgcagttcctcgggctctttgagaactctctgtgccgcctcacgcacattccagcctacaaagtaagtggtgacaaaaacgaagagcaggtgctgaatgccatcgaggcctacacggagcaccggcctgagatcacctcgcgggccatcaacttgctttttgacatcgcccgcatcgagcgttgcaaccagctgctgcgggccctgaagctggtcatcacggccctcaagtgccacaaatatgacaggaacattcaagtgacaggcagcgccgctctcttctacctaacaaattccgagtaccgctcagagcagagtgtgaagctgcgccggcaggttatccaggtggtgctgaatggcatggaatcctaccaggaggtgacggtgcagcggaactgctgcctgacgctctgcaacttcagcatccccgaggagctggaattccagtaccgccgggtcaacgagctcctgctcagcatcctcaaccccacgcggcaggacgagtctatccagcggatcgccgtgcacctgtgcaatgccctggtctgccaggtagacaacgaccacaaggaggccgtgggcaagatgggctttgtcgtgaccatgctgaagctgattcagaagaagctgctggacaagacatgtgaccaggtcatggagttctcctggagtgccctgtggaacatcacagatgaaactcctgacaactgcgagatgttcctcaatttcaacggcatgaagctcttcctggactgcctgaaggaattcccagagaagcaggaactgcataggaatatgctaggacttttggggaatgtggcagaagtgaaggagctgaggcctcaactaatgacttcccagttcatcagcgtcttcagcaacctgttggagagcaaggccgatgggatcgaggtttcctacaatgcctgcggcgtcctctcccacatcatgtttgatggacccgaggcctggggcgtctgtgagccccagcgtgaggaggtggaggaacgcatgtgggctgccatccagagctgggacataaactctcggagaaacatcaattacaggtcatttgaaccaattctccgcctccttccccagggaatctctcctgtcagccagcactgggcaacctgggccctgtataacctcgtgtctgtctacccggacaagtactgccctctgctgatcaaagaaggggggatgccccttctgagggacataattaagatggcgaccgcacggcaggagaccaaggaaatggcccgcaaggtgattgagcactgcagtaactttaaagaggagaacatggacacgtctagatagaggcctccgtccccatggccgccaccgctctggaccacaggcggggaggaagcatgctcaagcagcccagcgggcgggccccttccgagggagcctcccacggagtgaagagacatgggggacttttgcacaaccgacgcttttccttaatgttagtgagatatatatatattatatatatatattttttttttggttaggaagtgtgaagttttgtgtgtatgatttctgtgcaaaaacaaaagcaacactcctgagtccttgcagcttccttggccattctcaaacccactcagccttcatcgctgacacacacactcctaccccaaccagactaaatgcctataacgctgtgagtgtccagtccttgtccaggaaactcagatcccggcctggcttcctttcatgagaggagcaggccttggacagcgtatcgagcatcctgacccactgcccctgcctgagaacgccatctcggctcccgggcacagctgatggggtttggggattagaacttaccccactgggtctcccaaaagccttggtgctcccggctgtgggccatctggggcaggaaagtgagccattcctaggctgaggtccaggcagccctgcccctgaagaccctctaggagcagggcacccagtggccctgctgctgtccagccaggcctgcctgaggccacgctgctatggaggctgcctcctagtctcccaccaggtcccaggctgtggaaagccccagcccagggatggtcagaactcgggggcagattccactgccccttctgccaaacacatccagaacctgccctcagccctggaagctagcatcttctggggccaggggcttgcttcctcgctccatagccctcaactgcccaggcgctcccaccagcagaactgagcctgcctcctcctcccagcctgccccgctgcccagaggaccccacgcctctcagaggcagaggtcccatgccagcctttgacccacaacggccacacagccgcctccagaccagcactcggactgccctgcagtggccgcttgggcctccctggcggtcccgccctgccctaggctttaccttggaagcctgagaggcgccggctctcttgctcctccatcgatggacactgcattgcttctcatcggacacttgtggagcgcaggggcctggggagcagcgctaaccctggaggcagcctttgggtgatggctttttcttcccttttcctcccgcgggcctgttttcaggtgttcctagcatttctgcctccaggcaggacggcaggggtgagcagctttgggagagacacctggcctttttctcctggagcctctccctcccggccctgggaagtgggcgcagccctgtgttcccccagcttggcagatgggctgcatgcggcgctcccttccttcccacgctcagcggccccggccagaccctggcagacttcacacctcattgctttaccccctggggcctggggaaatgtctgtactttgggaagtcacagaaatacatttttgtgcaaaatggaaaa

SEQ ID NO: 454918 - DNA, 3739 bp, Homo sapiens
gaagtgacgcgccccgggtttgttgacagcggaggcggcggcggctgcaggctccgagccgtaggagccggatcgggggaggggccgggcccaggagcctcagccccgccggcagccctaagggcaaggcagtggctctgccaatgatcctgtgagtattcaggaatcactgttgcccctggggatccttgtcctggagtggcccacctgcttgcccccagcatggcgtccgacactcccgagtcgctgatggccctctgtactgacttctgcttgcgcaacctggatggcaccctgggctacctgctggacaaggagaccctgcggctacatccggacatcttcttgcccagcgagatctgtgaccggctcgtcaatgagtatgtggagctggtgaacgctgcctgtaacttcgagccacacgagagcttcttcagcctcttttcggacccccgcagcacccgcctcacgcggatccacctccgtgaggacctggtgcaggaccaggacctggaggccatccgcaagcaggacctggtggagctgtacctgactaactgcgagaagctgtccgccaagagcctgcagacactgaggagcttcagccacaccctggtgtccttgagcctcttcggctgtacaaacattttctatgaggaggagaacccagggggctgtgaagatgagtacctcgtcaaccccacctgccaggtgctggttaaggatttcaccttcgagggcttcagccgcctccgcttcctcaacttgggccgcatgattgattgggtccctgtggagtccctgctgcggccgcttaactccctggctgccttggacctctcaggcattcagacgagcgacgccgccttcctcacccagtggaaagacagcctggtgtccctcgtcctctacaacatggacctgtccgacgaccacatccgggtcatcgtgcagctgcacaagctgcgacacctggacatctcccgagaccgcctctccagctactacaagttcaagctgactcgggaggtgctgagcctctttgtgcagaagctggggaacctaatgtccctggacatctctggccacatgatcctagagaactgcagcatctccaagatggaagaggaagcggggcagaccagcattgagccttccaagagcagcatcatacctttccgggctctgaagaggccgctgcagttcctcgggctctttgagaactctctgtgccgcctcacgcacattccagcctacaaagtaagtggtgacaaaaacgaagagcaggtgctgaatgccatcgaggcctacacggagcaccggcctgagatcacctcgcgggccatcaacttgctttttgacatcgcccgcatcgagcgttgcaaccagctgctgcgggccctgaagctggtcatcacggccctcaagtgccacaaatatgacaggaacattcaagtgacaggcagcgccgctctcttctacctaacaaattccgagtaccgctcagagcagagtgtgaagctgcgccggcaggttatccaggtggtgctgaatggcatggaatcctaccaggaggtgacggtgcagcggaactgctgcctgacgctctgcaacttcagcatccccgaggagctggaattccagtaccgccgggtcaacgagctcctgctcagcatcctcaaccccacgcggcaggacgagtctatccagcggatcgccgtgcacctgtgcaatgccctggtctgccaggtagacaacgaccacaaggaggccgtgggcaagatgggctttgtcgtgaccatgctgaagctgattcagaagaagctgctggacaagacatgtgaccaggtcatggagttctcctggagtgccctgtggaacatcacagatgaaactcctgacaactgcgagatgttcctcaatttcaacggcatgaagctcttcctggactgcctgaaggaattcccagagaagcaggaactgcataggaatatgctaggacttttggggaatgtggcagaagtgaaggagctgaggcctcaactaatgacttcccagttcatcagcgtcttcagcaacctgttggagagcaaggccgatgggatcgaggtttcctacaatgcctgcggcgtcctctcccacatcatgtttgatggacccgaggcctggggcgtctgtgagccccagcgtgaggaggtggaggaacgcatgtgggctgccatccagagctgggacataaactctcggagaaacatcaattacaggtcatttgaaccaattctccgcctccttccccagggaatctctcctgtcagccagcactgggcaacctgggccctgtataacctcgtgtctgtctacccggacaagtactgccctctgctgatcaaagaaggggggatgccccttctgagggacataattaagatggcgaccgcacggcaggagaccaaggaaatggcccgcaaggtgattgagcactgcagtaactttaaagaggagaacatggacacgtctagatagaggcctccgtccccatggccgccaccgctctggaccacaggcggggaggaagcatgctcaagcagcccagcgggcgggccccttccgagggagcctcccacggagtgaagagacatgggggacttttgcacaaccgacgcttttccttaatgttagtgagatatatatatattatatatatatattttttttttggttaggaagtgtgaagttttgtgtgtatgatttctgtgcaaaaacaaaagcaacactcctgagtccttgcagcttccttggccattctcaaacccactcagccttcatcgctgacacacacactcctaccccaaccagactaaatgcctataacgctgtgagtgtccagtccttgtccaggaaactcagatcccggcctggcttcctttcatgagaggagcaggccttggacagcgtatcgagcatcctgacccactgcccctgcctgagaacgccatctcggctcccgggcacagctgatggggtttggggattagaacttaccccactgggtctcccaaaagccttggtgctcccggctgtgggccatctggggcaggaaagtgagccattcctaggctgaggtccaggcagccctgcccctgaagaccctctaggagcagggcacccagtggccctgctgctgtccagccaggcctgcctgaggccacgctgctatggaggctgcctcctagtctcccaccaggtcccaggctgtggaaagccccagcccagggatggtcagaactcgggggcagattccactgccccttctgccaaacacatccagaacctgccctcagccctggaagctagcatcttctggggccaggggcttgcttcctcgctccatagccctcaactgcccaggcgctcccaccagcagaactgagcctgcctcctcctcccagcctgccccgctgcccagaggaccccacgcctctcagaggcagaggtcccatgccagcctttgacccacaacggccacacagccgcctccagaccagcctggccaacacagtgaaaccccatctctgctaaaaatacaaaaattagccaggcatggtggtgggcacctgtaatcccagccccttgggaggctgaggcaggagaatcacttgaacctggaaggcggaggttgcagtgagccaagaactcgccactgcactccagcctgggcaacagagtgatactccatctc

SEQ ID NO: 454919 - DNA, 3485 bp, Homo sapiens
gaagtgacgcgccccgggtttgttgacagcggaggcggcggcggctgcaggctccgagccgtaggagccggatcgggggagggggctgtgaagatgagtacctcgtcaaccccacctgccaggtgctggttaaggatttcaccttcgagggcttcagccgcctccgcttcctcaacttgggccgcatgattgattgggtccctgtggagtccctgctgcggccgcttaactccctggctgccttggacctctcaggcattcagacgagcgacgccgccttcctcacccagtggaaagacagcctggtgtccctcgtcctctacaacatggacctgtccgacgaccacatccgggtcatcgtgcagctgcacaagctgcgacacctggacatctcccgagaccgcctctccagctactacaagttcaagctgactcgggaggtgctgagcctctttgtgcagaagctggggaacctaatgtccctggacatctctggccacatgatcctagagaactgcagcatctccaagatggaagaggaagcggggcagaccagcattgagccttccaagagcagcatcatacctttccgggctctgaagaggccgctgcagttcctcgggctctttgagaactctctgtgccgcctcacgcacattccagcctacaaagtaagtggtgacaaaaacgaagagcaggtgctgaatgccatcgaggcctacacggagcaccggcctgagatcacctcgcgggccatcaacttgctttttgacatcgcccgcatcgagcgttgcaaccagctgctgcgggccctgaagctggtcatcacggccctcaagtgccacaaatatgacaggaacattcaagtgacaggcagcgccgctctcttctacctaacaaattccgagtaccgctcagagcagagtgtgaagctgcgccggcaggttatccaggtggtgctgaatggcatggaatcctaccaggaggtgacggtgcagcggaactgctgcctgacgctctgcaacttcagcatccccgaggagctggaattccagtaccgccgggtcaacgagctcctgctcagcatcctcaaccccacgcggcaggacgagtctatccagcggatcgccgtgcacctgtgcaatgccctggtctgccaggtagacaacgaccacaaggaggccgtgggcaagatgggctttgtcgtgaccatgctgaagctgattcagaagaagctgctggacaagacatgtgaccaggtcatggagttctcctggagtgccctgtggaacatcacagatgaaactcctgacaactgcgagatgttcctcaatttcaacggcatgaagctcttcctggactgcctgaaggaattcccagagaagcaggaactgcataggaatatgctaggacttttggggaatgtggcagaagtgaaggagctgaggcctcaactaatgacttcccagttcatcagcgtcttcagcaacctgttggagagcaaggccgatgggatcgaggtttcctacaatgcctgcggcgtcctctcccacatcatgtttgatggacccgaggcctggggcgtctgtgagccccagcgtgaggaggtggaggaacgcatgtgggctgccatccagagctgggacataaactctcggagaaacatcaattacaggtcatttgaaccaattctccgcctccttccccagggaatctctcctgtcagccagcactgggcaacctgggccctgtataacctcgtgtctgtctacccggacaagtactgccctctgctgatcaaagaaggggggatgccccttctgagggacataattaagatggcgaccgcacggcaggagaccaaggaaatggcccgcaaggtgattgagcactgcagtaactttaaagaggagaacatggacacgtctagatagaggcctccgtccccatggccgccaccgctctggaccacaggcggggaggaagcatgctcaagcagcccagcgggcgggccccttccgagggagcctcccacggagtgaagagacatgggggacttttgcacaaccgacgcttttccttaatgttagtgagatatatatatattatatatatatattttttttttggttaggaagtgtgaagttttgtgtgtatgatttctgtgcaaaaacaaaagcaacactcctgagtccttgcagcttccttggccattctcaaacccactcagccttcatcgctgacacacacactcctaccccaaccagactaaatgcctataacgctgtgagtgtccagtccttgtccaggaaactcagatcccggcctggcttcctttcatgagaggagcaggccttggacagcgtatcgagcatcctgacccactgcccctgcctgagaacgccatctcggctcccgggcacagctgatggggtttggggattagaacttaccccactgggtctcccaaaagccttggtgctcccggctgtgggccatctggggcaggaaagtgagccattcctaggctgaggtccaggcagccctgcccctgaagaccctctaggagcagggcacccagtggccctgctgctgtccagccaggcctgcctgaggccacgctgctatggaggctgcctcctagtctcccaccaggtcccaggctgtggaaagccccagcccagggatggtcagaactcgggggcagattccactgccccttctgccaaacacatccagaacctgccctcagccctggaagctagcatcttctggggccaggggcttgcttcctcgctccatagccctcaactgcccaggcgctcccaccagcagaactgagcctgcctcctcctcccagcctgccccgctgcccagaggaccccacgcctctcagaggcagaggtcccatgccagcctttgacccacaacggccacacagccgcctccagaccagcactcggactgccctgcagtggccgcttgggcctccctggcggtcccgccctgccctaggctttaccttggaagcctgagaggcgccggctctcttgctcctccatcgatggacactgcattgcttctcatcggacacttgtggagcgcaggggcctggggagcagcgctaaccctggaggcagcctttgggtgatggctttttcttcccttttcctcccgcgggcctgttttcaggtgttcctagcatttctgcctccaggcaggacggcaggggtgagcagctttgggagagacacctggcctttttctcctggagcctctccctcccggccctgggaagtgggcgcagccctgtgttcccccagcttggcagatgggctgcatgcggcgctcccttccttcccacgctcagcggccccggccagaccctggcagacttcacacctcattgctttaccccctggggcctggggaaatgtctgtactttgggaagtcacagaaatacatttttgtgcaaaatggaaaa

SEQ ID NO: 454920 - DNA, 2682 bp, Homo sapiens
gaagtgacgcgccccgggtttgttgacagcggaggcggcggcggctgcaggctccgagccgtaggagccggatcgggggaggggccgggcccaggagcctcagccccgccggcagccctaagggcaaggcagtggctctgccaatgatcctgtgagtattcaggaatcactgttgcccctggggatccttgtcctggagtggcccacctgcttgcccccagcatggcgtccgacactcccgagtcgctgatggccctctgtactgacttctgcttgcgcaacctggatggcaccctgggctacctgctggacaaggagaccctgcggctacatccggacatcttcttgcccagcgagatctgtgaccggctcgtcaatgagtatgtggagctggtgaacgctgcctgtaacttcgagccacacgagagcttcttcagcctcttttcggacccccgcagcacccgcctcacgcggatccacctccgtgaggacctggtgcaggaccaggacctggaggccatccgcaagcaggacctggtggagctgtacctgactaactgcgagaagctgtccgccaagagcctgcagacactgaggagcttcagccacaccctggtgtccttgagcctcttcggctgtacaaacattttctatgaggaggagaacccagggggctgtgaagatgagtacctcgtcaaccccacctgccaggtgctggttaaggatttcaccttcgagggcttcagccgcctccgcttcctcaacttgggccgcatgattgattgggtccctgtggagtccctgctgcggccgcttaactccctggctgccttggacctctcaggcattcagacgagcgacgccgccttcctcacccagtggaaagacagcctggtgtccctcgtcctctacaacatggacctgtccgacgaccacatccgggtcatcgtgcagctgcacaagctgcgacacctggacatctcccgagaccgcctctccagctactacaagttcaagctgactcgggaggtgctgagcctctttgtgcagaagctggggaacctaatgtccctggacatctctggccacatgatcctagagaactgcagcatctccaagatggaagaggaagcggggcagaccagcattgagccttccaagagcagcatcatacctttccgggctctgaagaggccgctgcagttcctcgggctctttgagaactctctgtgccgcctcacgcacattccagcctacaaagtaagtggtgacaaaaacgaagagcaggtgctgaatgccatcgaggcctacacggagcaccggcctgagatcacctcgcgggccatcaacttgctttttgacatcgcccgcatcgagcgttgcaaccagctgctgcgggccctgaagctggtcatcacggccctcaagtgccacaaatatgacaggaacattcaagtgacaggcagcgccgctctcttctacctaacaaattccgagtaccgctcagagcagagtgtgaagctgcgccggcaggttatccaggtggtgctgaatggcatggaatcctaccaggaggtgacggtgcagcggaactgctgcctgacgctctgcaacttcagcatccccgaggagctggaattccagtaccgccgggtcaacgagctcctgctcagcatcctcaaccccacgcggcaggacgagtctatccagcggatcgccgtgcacctgtgcaatgccctggtctgccaggtagacaacgaccacaaggaggccgtgggcaagatgggctttgtcgtgaccatgctgaagctgattcagaagaagctgctggacaagacatgtgaccaggtcatggagttctcctggagtgccctgtggaacatcacagatgaaactcctgacaactgcgagatgttcctcaatttcaacggcatgaagctcttcctggactgcctgaaggaattcccagagaagcaggaactgcataggaatatgctaggacttttggggaatgtggcagaagtgaaggagctgaggcctcaactaatgacttcccagttcatcagcgtcttcagcaacctgttggagagcaaggccgatgggatcgaggtttcctacaatgcctgcggcgtcctctcccacatcatgtttgatggacccgaggcctggggcgtctgtgagccccagcgtgaggaggtggaggaacgcatgtgggctgccatccagagctgggacataaactctcggagaaacatcaattacaggtcatttgaaccaattctccgcctccttccccagggaatctctcctgtcagccagcactgggcaacctgggccctgtataacctcgtgtctgtctacccggacaagtactgccctctgctgatcaaagaaggggggatgccccttctgagggacataattaagatggcgaccgcacggcaggagaccaaggaaatggcccgcaaggtgattgagcactgcagtaactttaaagaggagaacatggacacgtctagatagaggcctccgtccccatggccgccaccgctctggaccacgctcagcggccccggccagaccctggcagacttcacacctcattgctttaccccctggggcctggggaaatgtctgtactttgggaagtcacagaaatacatttttgtgcaaaatggaaaa

SEQ ID NO: 454921 - DNA, 1533 bp, Homo sapiens
gaagtgacgcgccccgggtttgttgacagcggaggcggcggcggctgcaggctccgagccgtaggagccggatcgggggaggggccgggcccaggagcctcagccccgccggcagccctaagggcaaggcagtggctctgccaatgatcctgtgagtattcaggaatcactgttgcccctggggatccttgtcctggagtggcccacctgcttgcccccagcatggcgtccgacactcccgagtcgctgatggccctctgtactgacttctgcttgcgcaacctggatggcaccctgggctacctgctggacaaggagaccctgcggctacatccggacatcttcttgcccagcgagatctgtgaccggctcgtcaatgagtatgtggagctggtgaacgctgcctgtaacttcgagccacacgagagcttcttcagcctcttttcggacccccgcagcacccgcctcacgcggatccacctccgtgaggacctggtgcaggaccaggacctggaggccatccgcaagcaggacctggtggagctgtacctgactaactgcgagaagctgtccgccaagagcctgcagacactgaggagcttcagccacaccctggtgtccttgagcctcttcggctgtacaaacattttctatgaggaggagaacccagggggctgtgaagatgagtacctcgtcaaccccacctgccaggtgctggttaaggatttcaccttcgagggcttcagccgcctccgcttcctcaacttgggccgcatgattgattgggtccctgtggagtccctgctgcggccgcttaactccctggctgccttggacctctcaggcattcagacgagcgacgccgccttcctcacccagtggaaagacagcctggtgtccctcgtcctctacaacatggacctgtccgacgaccacatccgggtcatcgtgcagctgcacaagctgcgacacctggacatctcccgagaccgcctctccagctactacaagttcaagctgactcgggaggtgctgagcctctttgtgcagaagctggggaacctaatgtccctggacatctctggccacatgatcctagagaactgcagcatctccaagatggaagaggaagcggggcagaccagcattgagccttccaagagcagcatcatacctttccgggctctgaagaggccgctgcagttcctcgggctctttgagaactctctgtgccgcctcacgcacattccagcctacaaagtaagtggtgacaaaaacgaagagcaggtgctgaatgccatcgaggcctacacggagcaccggcctgagatcacctcgcgggccatcaacttgctttttgacatcgcccgcatcgagcgttgcaaccagctgctgcgggccctgaagctggtcatcacggccctcaagtgccacaaatatgacaggaacattcaagtgacaggcagcgccgctctcttctacctaacaaagtgctcgagaaaccgtcgaattcgataagatccggtagagtca

SEQ ID NO: 454922 - DNA, 832 bp, Homo sapiens
  misc_feature (821)..(822): n is a, c, g, or t
  misc_feature (825)..(825): n is a, c, g, or t
gaagtgacgcgccccgggtttgttgacagcggaggcggcggcggctgcaggctccgagccgtaggagccggatcgggggaggggccgggcccaggagcctcagccccgccggcagccctaagggcaaggcagtggctctgccaatgatcctgtgagtattcaggaatcactgttgcccctggggatccttgtcctggagtggcccacctgcttgcccccagcatggcgtccgacactcccgagtcgctgatggccctctgtactgacttctgcttgcgcaacctggatggcaccctgggctacctgctggacaaggagaccctgcggctacatccggacatcttcttgcccagcgagatctgtgaccggctcgtcaatgagtatgtggagctggtgaacgctgcctgtaacttcgagccacacgagagcttcttcagcctcttttcggacccccgcagcacccgcctcacgcggatccacctccgtgaggacctggtgcaggaccaggacctggaggccatccgcaagcaggacctggtggagctgtacctgactaactgcgagaagctgtccgccaagagcctgcagacactgaggagcttcagccacaccctggtgtccttgagcctcttcggctgtacaaacattttctatgaggaggagaacccagggggctgtgaagatgagtacctgcttcccccgtcgtcggagccgctgcgtgtggcgatggtacagtcagagacggcccccgcgctataaacagcgccaggcgcatggtcgtcggtaggcgcttagattaccggcgcacggcggggccgcannagnctatatt

SEQ ID NO: 454923 - DNA, 4768 bp, Homo sapiens
gcacgcgcctgaagcacaaagcagatagctaggaatgaaccatccctgggagtatgtggaaacaacggaggagctctgacttcccaactgtcccattctatgggcgaaggaactgctcctgacttcagtggttaagggcagaattgaaaataattctggaggaagataagaatgattcctgcgcgactgcaccgggactacaaagggcttgtcctgctgggaatcctcctggggactctgtgggagaccggatgcacccagatacgctattcagttccggaagagctggagaaaggctctagggtgggcgacatctccagggacctggggctggagccccgggagctcgcggagcgcggagtccgcatcatccccagaggtaggacgcagcttttcgccctgaatccgcgcagcggcagcttggtcacggcgggcaggatagaccgggaggagctctgtatgggggccatcaagtgtcaattaaatctagacattctgatggaggataaagtgaaaatatatggagtagaagtagaagtaagggacattaacgacaatgcgccttactttcgtgaaagtgaattagaaataaaaattagtgaaaatgcagccactgagatgcggttccctctaccccacgcctgggatccggatatcgggaagaactctctgcagagctacgagctcagcccgaacactcacttctccctcatcgtgcaaaatggagccgacggtagtaagtaccccgaattggtgctgaaacgcgccctggaccgcgaagaaaaggctgctcaccacctggtccttacggcctccgacgggggcgacccggtgcgcacaggcaccgcgcgcatccgcgtgatggttctggatgcgaacgacaacgcaccagcgtttgctcagcccgagtaccgcgcgagcgttccggagaatctggccttgggcacgcagctgcttgtagtcaacgctaccgaccctgacgaaggagtcaatgcggaagtgaggtattccttccggtatgtggacgacaaggcggcccaagttttcaaactagattgtaattcagggacaatatcaacaataggggagttggaccacgaggagtcaggattctaccagatggaagtgcaagcaatggataatgcaggatattctgcgcgagccaaagtcctgatcactgttctggacgtgaacgacaatgccccagaagtggtcctcacctctctcgccagctcggttcccgaaaactctcccagagggacattaattgcccttttaaatgtaaatgaccaagattctgaggaaaacggacaggtgatctgtttcatccaaggaaatctgccctttaaattagaaaaatcttacggaaattactatagtttagtcacagacatagtcttggatagggaacaggttcctagctacaacatcacagtgaccgccactgaccggggaaccccgcccctatccacggaaactcatatctcgctgaacgtggcagacaccaacgacaacccgccggtcttccctcaggcctcctattccgcttatatcccagagaacaatcccagaggagtttccctcgtctctgtgaccgcccacgaccccgactgtgaagagaacgcccagatcacttattccctggctgagaacaccatccaaggggcaagcctatcgtcctacgtgtccatcaactccgacactggggtactgtatgcgctgagctccttcgactacgagcagttccgagacttgcaagtgaaagtgatggcgcgggacaacgggcacccgcccctcagcagcaacgtgtcgttgagcctgttcgtgctggaccagaacgacaatgcgcccgagatcctgtaccccgccctccccacggacggttccactggcgtggagctggctccccgctccgcagagcccggctacctggtgaccaaggtggtggcggtggacagagactccggccagaacgcctggctgtcctaccgtctgctcaaggccagcgagccgggactcttctcggtgggtctgcacacgggcgaggtgcgcacggcgcgagccctgctggacagagacgcgctcaagcagagcctcgtagtggccgtccaggaccacggccagccccctctctccgccactgtcacgctcaccgtggccgtggccgacagcatcccccaagtcctggcggacctcggcagcctcgagtctccagctaactctgaaacctcagacctcactctgtacctggtggtagcggtggccgcggtctcctgcgtcttcctggccttcgtcatcttgctgctggcgctcaggctgcggcgctggcacaagtcacgcctgctgcaggcttcaggaggcggcttgacaggagcgccggcgtcgcactttgtgggcgtggacggggtgcaggctttcctgcagacctattcccacgaggtttccctcaccacggactcgcggaagagtcacctgatcttcccccagcccaactatgcagacatgctcgtcagccaggagagctttgaaaaaagcgagccccttttgctgtcaggtgattcggtattttctaaagacagtcatgggttaattgagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454924 - DNA, 4753 bp, Homo sapiens
ctcccacacagaggctcccggctgcgcagaccttgcccagcacaccagattgccagctccgagacccgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtactatttcctttgctgctgcctttgttctaccccacgctgtgtgagccgatccgctactcgattccggaggagctggccaagggctcggtggtggggaacctcgctaaggatctagggcttagtgtcctggatgtgtcggctcgcgagctgcgagtgagcgcggagaagctgcacttcagcgtagacgcgcagagcggggacttacttgtgaaggaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaattccggaaagatgaaataaacttagaaatcagtgaatccgtcagcctggggatgggaacaattcttgagtctgcagaagatcctgatattagtatgaattcgctgagcaaataccaactaagtcctaacgagtatttctcattggtggagaaagacaatcctgatggtggcaaatatccagaattagtattgcagaagactctggaccgagaaacgcagagcgctcaccacttggtactgaccgccttagatggtggggaccctccccgaagcggtactgctcagataagaatcctggtaatagatgccaatgacaaccccccagtgttcagccaggacgtgtacagggttagccttcgggaagacgtgcctccaggcacctccatcctgagagtgaaggccactgaccaggacgagggcatcaactcagagatcacttattccttctttggtgtggctgacaaagctcagcacgtgttctctctggattacactacaggaaacattctaactcagcagcctttggattttgaagaagtagaaagatatacgataaacatagaagcaaaagaccgaggatctctctcaacacggtgtaaagtaattgtagaagttgtagacgaaaacgacaacagcccagaaataatcatcacgtcactctctgatcagattatggaggattcccctccaggagtggttgttgccctcttcaaaacacgggaccaagactcaggggaaaatggggaagtcaggtgtagcttaagtagaggtgttccatttaagattcattcttcttctaataattactacaagctagtaacagatgaggccctggatcgggagcagaccccagagtacaacgtcaccatcgcagccacagacaggggcaagcctccgttatcctccagcaaaaccataaccctgcacattactgacgtcaatgacaacgcgccggttttcggacagtcagcctacctggtccacgtgccagaaaacaaccagccgggtgcctccatagcgcaagtcagtgcctctgacccagacttcgggctcaacggccgtgtctcctactctctcattgccagcgacctggagtcacgaacgctgtcgtcctacgtgtccgtgagcgcgcagagcggggtggtgttcgcgcagcgcgccttcgaccacgagcagctgcgcaccttcgagctcacgctgcaggcccgcgaccagggctcgcccgcgctcagcgccaatgtgagcctgcgcgtgttggtgggcgaccgtaacgacaacgcaccgcgggtgctgtaccctgcgctgggtcccgacggctccgcgctcttcgacacagtgccgcgggccgcgcagccaggctacctggtgaccaaggtggtggccgtggacgcggactcggggcacaatgcctggctgtcctaccacgtggtgcaggccagtgagcccgggctcttcagcctggggctgcgaacaggcgaggtgcgcatggtgcgtgctttgggtgacaaggactcggtccgccagcgcctgctagtcgctgtaagagatggaggacagccacccctttcagccactgccacgctgcacctggtgttcgcagatagcttgcaagaggtactgccggatttcagcgaccatcccacaccctctgactcccaggctgagatgcagttttacctggtggtggccttggccttgatttctgtgctctttctcctcgcggtgattctagctattgctctacgcctgcgacagtctttcagccctactgcaggagactgctttgagtcagttctctgctccaagtccggacctgtgggtccccccaactacagtgagggaacgttgccctatgcctataatttttgtgtgcctggggatcaaatgaatccagaatttaattttttcacatctgttgatcattgtccagccacacaagataacctcaacaaagatagcatgctactggctagcattttaactcccagcgttgaagcagataagaagattcttaaacagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454925 - DNA, 4758 bp, Homo sapiens
cagggcagccccagctcagactccccagcgccagcctttacaccgcttcctcctcggaaaaagaagaattttttcttgaactggaactgcaactaaagtccgttcggagatccaaaaatctgcaatacagaggttatttgtaacccggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacacgatttatattaggatctgcccatgatgcggatattggtagcaacacactgcagaattaccaactcagtcccagtgatcatttctcactgataaataaagagaaatcagatggcagtaaataccctgagatggtattgaagacacctttggacagagaaaagcagaaatcctaccacttgactttgactgccttggactttggagctccacccctaagcagcactgcacagatacacgttctagtgactgatgccaatgataatgctccagtgttcagtcaagacgtatacagggtgagcctttcagaaaacgtgtacccggggaccacggtgctacaggtgactgccacggaccaggatgagggtgtcaatgccgagattactttctctttcagtgaagctagccagatcacccaatttgacctgaactctaacaccggggaaattactgttttaaatacattagattttgaagaagtcaaagaatattccatagttttggaagcaagggacggtggaggaatgattgcgcaatgcacagtggaggtagaagtcatagatgaaaatgacaacgccccagaagtgatattccagtctctacccaacctaattatggaggacgccgagctgggaacacatattgctttgctcaaagtccgtgacaaggattccagacacaatggagaagtgacttgtaaattggaaggtgatgttccatttaaaatattaacttcttcaagaaacacgtataaattagtgacagatgctgttctagaccgcgagcagaatccagagtacaatataaccgttacggcaacagatcggggcaagcctcccctctcctccagttccagcatcaccctgcacattggtgatgtaaatgacaacgctccggttttctcacagtcttcctatatagtccacgtggccgagaacaacccgcctggagcctctatttcacaagtcagggcttctgatccggacttggggcccaacggccaagtctcttactgcatcatggccagtgacctggagcagcgggagctgtcatcctacgtgtccataagcgcggagagcggggtggtgttcgcgcagcgcgccttcgaccacgagcagctgcgcgccttcgaactcacactgcaggcccgcgaccagggctcgccagcgctcagcgcgaacgtgagcctgcgcgtgttagtggacgaccgcaacgacaatgcgccacgggtgctgtaccccgcgctgggtcccgacggctctgcgctcttcgatatggtgccgcacgctgcagagcctggctacttggtgaccaaggtagtggcggtggacgcagactcaggacacaacgcctggctgtcctaccacgtgctgcaggctagcgagcccgggctcttcagcctggggctgcgcacgggcgaagtgcgcacagcgcgtgccttaggcgacagggacgccgtccgccagcgccttctggtcgccgtgcgtgacggtggacagccaccactctcggccactgccacgttgcacctggtcttcgccgacagcttgcaggaggtgctgccggatatcactgaccgccccgacccctctgacctccaggctgagctgcagttttacctagtggtggccttggccttgatctcagtgctcttcctcgtggccatgattctggccattgccttgcgcctgcgacgctcctccagccccgcctcctggagctgcttccagcctggtctctgtgttaaatccgaatccgtggttccccccaactacagcgaggggactttgccttattcctacaatctatgtgttgcacatacaggaaagacggagtttaatttcctaaaatgtagtgagcagttgagttcaggacaagacatactttgcggtgattcatctggggccttatttccactttgtaattccagtgaattgacttcccatcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454926 - DNA, 4594 bp, Homo sapiens
atggcgagtccacctaggggctggggctgcggagagctgctgctgcccttcatgctcctggggacgctgtgcgagccaggatccgggcagatccgctactcgatgccggaggagctggacaaaggctccttcgtcggcaacatagccaaggaccttgggctggagccccaggagctggcggagcgcggagtccgcatcgtctccagaggtaggacgcagctttttgccctgaacccgcgaagcggcagcttggtcaccgcgggcaggatagaccgggaggagctctgcgctcagagcccactgtgtgtggtgaactttaacatcttggttgagaacaaaatgaaaatttatggagtagaagtagaaataatcgatattaatgataacttcccgcgtttccgggatgaagagttaaaagtaaaagttaatgaaaatgcggctgcagggacacggttagtgcttcccttcgcgcgggatgcggatgtgggtgtgaactctctccggagttaccagctcagctccaatctgcacttctctctggatgtggtaagcggaactgatggacaaaagtatccggagctggtgttggaacagcccctagaccgcgagaaagagactgttcacgacctcctcctcacagctttagatggcggagacccggtactctccggcaccacgcacatccgtgttacggtcctcgacgcaaacgacaatgcgcccctgttcaccccatccgagtacagcgtgagtgttccagagaacatacctgtgggcactcggctgctcatgctaaccgccacggatccagatgagggaataaacgggaaattgacctactcttttcgcaatgaagaagaaaaaatttcggagactttccaacttgattccaacctgggggaaatctcaactctacaatcactggactatgaagaatccagattctacctcatggaagtggtagctcaggatggaggcgctcttgttgccagcgctaaggtggtggtcacagtacaggacgtgaatgacaatgcccccgaagtgatcctcacctctctgaccagttcgatctctgaagactgtcttcccggaactgtaatcgcgctgtttagcgtacatgatggtgattctggagaaaatggtgagattgcatgctctattcctaggaatttgccttttaaattggagaagtcagttgataattactatcacctattaacaactagggacctggacagagaagagacttcagattataatatcactttaaccgtcatggaccatggaaccccgcccctctctacagaaagccacatccccttgaaagtagcagacgttaatgacaacccacccaatttccctcaagcctcctactccacctctgtcacagaaaacaatcccagaggtgtctctatcttctctgtgacagcccatgaccccgacagcggcgacaacgctcgagtcacctactccctggctgaagacacatttcagggggcgcccttgtcctcctatgtatccattaactctgacaccggtgtcctgtatgctctgagatccttcgactatgagcagttgagagacctacagttgtgggtgacagccagcgacagtgggaaccctccacttagcagcaacgtgtcgctgagcctgtttgtgctggaccagaacgacaatacgcctgagatcctgtaccccgccctccccacagacggttccacgggcgtggagctggcgcctcgctccgcagaacctggctacctggtgaccaaggtggtagcggtggacaaagattcaggccagaacgcctggctgtcctaccgcctgcttaaggccagcgagccaggactctttgcggttgggctgcacacgggcgaggtgcgcacagcgcgagccctgctggacagagacgcgctcaagcagagcctcgtggtggccgtcgaagaccatggccagccccctctgtcagccaccttcacggtcaccgttgccgtggccgacaggatccctgacatcctggctgacctaggcagtatcaagacccccattgaccctgaggatctggacctcacactctatcttgtggtggcagtggctgcagtctcctgcgtcttcctggccttcgtcatcgtgctgctggtgctcagactgaggcgctggcacaagtcacgcctgcttcaggctgaaggcagcaggttggcgggtgtgcccgcctcgcactttgtgggcgtggatggggttcgggctttcctgcagacctattcccacgaggtctccctcaccgcggactcgaggaagagtcacctgatctttccccagcccaactacgcagacacgctccttagtgaagagagctgtgagaaaagcgagcctcttctgatgtctgataaggtagatgcaaacaaagaagaacggcgagttcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454927 - DNA, 4789 bp, Homo sapiens
acagcacaagggggtggaggtttggccctaaagcttcaggacaccaaagaaattcagtcgaacagcccaccagttctctccatagggacctgggtcccgtgaatgctggttatctcacaccctgaggaataaagattggaatccgcactggatgctggaagttgactcggagaaaattgcgacaggagggaaatggcggctctgcaaaagttgccacactgcagaaagctggtcctgctgtgcttccttttggcgaccctgtgggaggccagggccgggcagattcgctattctgtgcgggaagagatcgacagaggctccttcgtaggcaacatcgccaaggacttgggtttggagcccctggcactggcagagcagggagtccgcatcgtctccagaggtaggtcccagctctttgctctgaacccgcgaagcggcagcttggtcactgcgaacaggatagaccgggaggagctctgcgctcagagcgcaccctgtctgttgaattttaacattctgctggaggataaattgactatttattcagtagaggtggaaataacagatattaacgataatgcccctcgctttggagtagaggaactggagctaaaaatcagtgaaaccactacgccaggattccggattcctcttaagaatgcgcatgatgcagacgtaggtgagaacgcccttcagaagtacgcactcaacccaaatgaccacttctccctggacgtgcgaaggggagctgatgggaacaagtacccagaactggtgctggagcgctctctggaccgcgaggaagaggctgttcaccacctcgttctcgtggcttctgatgggggtgacccagtgctatctggcacctcccgcatctgcgtgaaggtcctggatgcgaacgacaatgcgcctgtttttacacagcccgagtaccgcataagcattccggagaatacgctcgtgggcacccggatactcacggtgaccgccactgacgcagatgagggctactacgctcaagtggtatattttctagagaaaagccctggagaaacctcagaggtatttgagcttaagtcaacatctggagaactgacaatcataaaagatctagattatgaggatgctacattccatgaaattgatattgaagctcaggatggtccgggccttctaaccagagcgaaggttatcgtcacggttctggatgtgaatgacaatgccccagaattttacatgacatctgctactagctcagtttctgaagactctcttccaggaaccataattgggctttttaatgtacatgatagagactctgggcagaacgcattcaccacctgttcactccccgaggatcttccttttaagttagaaaagtcagtagacaattactaccgactggttacaaccagagcccttgacagggaacagttttccttttacaacatcactctaaccgctaaagatggagggaacccctccctgtccacggatgctcacattttgctccaggtggcagacatcaacgacaacgcacccgccttctcccgcacatcctactccacctacattcccgaaaacaaccccagaggagcctctgtcttctcagtgacggcccatgaccccgacagcaacgacaatgctcatgtaacttactctttcgcggaggacactgttcagggggcacccttatcctcttacatctctatcaactccgacactggagtactctatgcactgcgctcctttgattatgagcagttgcgagacttgcaagtgtgggtgatagcgcgggacagcgggaaccctccactcagtagcaatgtatcattaagcctgttcgtgctggaccagaacgacaacgcgcccgagatcctgtaccctgccttccccacagacggttccactggcgtggagctggcgccccgctccgcagagcccggctacctggtgaccaaggtggtggcggtggacagagactcgggccagaacgcctggctgtcttaccacctgctcaaggccagcgagccgggactcttctcggtgggtctgcacacgggcgaggtgcgcacggcgcgagccctgctggacagagacgcgctcaagcagagcctcgtggtggccatccaggaccacggccagccccctctctccgccactgtcacgctcaccgtggccgtggccgacaggatccccgacatcctggccgacctgggcagcctcgagccctccgccatacccaacgattcggacctcactctgtacctggtggtggcggtggccgcggtctcctgcgtcttcctggccttcgtcatcgtgttgctggcgcacaggctgcggcgctggcacaagtcacgcctgctgcaggcttcaggaggcagcttgacaggcatgcagagctcgcactttgtgggcgtggacggggttcgggctttcctgcagacctattcccacgaggtctccctcactgcggactcgcggaagagccacctgattttcccccagcccaactatgcggacacgctcatcagccaggagagctgtgagaaaaaggattttttatcagcgcctcaatctctactcgaagaagaaagagaagaaacgttttctcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454928 - DNA, 4736 bp, Homo sapiens
gctgcgcagacctttcccagcacagcggattgccagctccgagacccgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtgctatttcctttgctgctgcctttgttctaccccaccctgagtgagccgatccgctactcgattccggaggagctggccaagggctcggtggtggggaacctcgctaaggatctagggctcagtgtcctggatgtgtcggctcgcaagctgcgagtgagcgcggagaagctgcacttcagcgtagacgcggagagcggggacttacttgtgaagaaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaatttgataaaaaggaaatacatttagaaattttcgaatctgcatccgctggtacacgactatcgcttgaccctgccacggatcctgatataaacataaactcaattaaagattataagataaactctaatccttatttttcattaatggttagagttaattccgatggtggcaaatacccagagttatctctggagaaactcctagaccgggaagaacagagatctcatagcttgatattgactgccttggacggaggggacccaccaagaagtgccaccgctcacatagaaatttctgtcaaggataccaatgataaccccccggttttcagcagagacgaatatagaattagtcttagtgaaaatctgccccctgggtcccctgtgttgcaagtgacagccactgaccaggatgagggggtcaatgctgagataaactactacttccgaagcactgcccagagcacaaaacatatgttctcattggatgagaaaacaggtatgattaagaataaccagtcatttgattttgaagatgtagaaaggtacaccatggaagtggaagcgaaggacggaggtggtctctctacccagtgtaaagtaatcatagaaatccttgatgaaaacgacaacagcccagaaataatcatcacttctctctctgatcagattttggagaattcacctccaggaatggttgttgccctcttcaaaacacgggatctggatttcggaggaaatggagaagtcaggtgtaatatagaaacagacattccattcaagatttattcttcttccaataactactacaaactggtgacagatggagccctggaccgagagcagacaccagaatacaatgtcaccatcgtagccactgacaggggcaagccgcctctttcttccagtagaagcatcaccttgtatgtcgctgacatcaacgacaacgccccagttttcgaccagacgtcctacgtggtccacgtggccgagaacaacccgccaggagcctccattgcgcaagtgagcgcctctgacccggatttggggctcaatggccacatctcctactctatagtggcgagtgacctagagcccctggcggtgtcgtcatacgtgtcagtgagcgcgcagagcggggtggtgttcgcgcagcgcgcctttgatcacgagcagctgcgcgccttcgcgctcacgctgcaggcccgcgaccacggctcgcccacgctcagcgccaacgtgagcctgcgcgtgttggtgggagaccgcaatgacaacgcaccgcgggtgctgtacccagctctgggtcctgacggctccgcgttcttcgatatggtacctcgctctgcagagcccggctacctagtgactaaggtggtagcggtggacgccgactcgggacacaacgcctggctgtcctaccacgtgctgcaggccagtgagcccggactcttcagcctggggctgcgcactggggaggtgcgcacggctcgagccttaggcgacagggacgcagcccgccagcgcctgctggtcgctgtgcgtgacggtggacagccgccactctctgccaccgccacgcttcatctggtcttcgcagacaacttgcaagagatactgccagacctcagcgaccgccctgtactctctgacccccaggctgaactgcagttttacctggtggtggccttggccttaatctcagtgctcttcctcctcgccgtgattctggccattgccttgcgcctgcgacgctctctcagccctgctacttgggactgcttccatcctggtctctgtgtcaagtctggacctgtagttccccccaactacagtgaggggactttgccttattcttataatctgtgcattgcacatacgggtacaaaagagtttaatttcctaaaatgcagtgtgcccctacattccaatgaagacatggtttgcagtgtttctcctggagccttaattccacctcatggtggggaggatttgacttcacatcctgagactctgacttcgcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454929 - DNA, 4594 bp, Homo sapiens
atggcggcgcctcctgctcgcccagaccacacccggctgctccagatctgccttctcctgggggttctggtggaaatcagggccgaacagattctctactcggtgtttgaggagcaggaagaaggctcagtggtgggcaacatcgccaaggacctggggttggcgccccgggagctggcggagcgcggagtccgcatcgtctccagaggtaggacgcagcttttcgccctgaacccgcgcagcggcaccttggtcaccgcgggtaggatagacagggaggagctctgcgacagatctccaaactgtgtgacaaacctggagattcttctagaagatacagtgaagattttgcgggtagaggtggaaataatcgatgttaatgataacccacccagttttgggacagaacagagggaaataaaagttgctgaaaatgaaaatcctggggcaagatttcctcttcctgaagcttttgatccggatgtaggtgtaaactccctgcagggttaccagctcaactcaaacggttacttttccctggacgtgcaaagtggggccgatgggattaagtacccagagctggtgctggaacgcgctctagatcgcgaggaagaggcggttcaccacctcgttctcacggccttcgatggaggtgacccggttcgctctggcactgccaggattctcataatacttgtggataccaacgataatgctcccgtgttcactcagcccgagtaccacgtaagtgttcgtgagaacgttcctgtaggcactcggctactcaccgtaaaagccactgatccagatgaaggagccaatggagacgtgacgtattctttccggaaagtaagagacaaaatatcacagctatttcagttgaattctctgagtggggatataacaatattggggggtctagattatgaggactctggattctatgacatagatgtagaagcccatgatgggcctggtctccgagctagaagcaaggtactggtgacagttctggatgaaaatgacaacgcaccagaagtcacagttacatctctcaccagctcagtccaggaatcttcttccccgggtacagtaattgcacttttcaacgtgcatgacagtgactcaggaggaaatggcctagtcacatgttctattccagataatctgccattcacacttgaaaagacctatggaaattattatcggttgttgacacacagaacactggacagggaagaagtctcagaatataacatcactgtaactgccactgaccagggaactcctccactgtctacagaaactcatatttcactgcaagtgatggacatcaatgacaacccacccactttccctcatgcttcctactctgcttacattcctgaaaacaaccccagaggagcctccatcttatctatgactgctcaagaccctgacagtggtgacaatgcccgaatcacttactccctggccgaagacaccttccagggtgcacctctgtcctcctatgtctccatcaactccaatacagggatcctatatgctctttgctccttcgactatgagcagtttagagacctgcagctgctgatgacagccagtgacagtggagaccctccactcagcagcaatgtgtcactgagcctctttgtgctggaccagaacgacaatgtccctgagatcctgtaccccaccttccctactgatggctccactggtgtggagctggcaccccgctccgcagattccggctacctggtgaccaaagtggtggcagtggacagagactcaggtcagaatgcctggctgtcctacagcctactcaagtccagcgagccgggactatttgcagtggggctgcacacaggcgaggtgcgcaccgcacgggccctgctggacagagacgcgctcaagcagaggcttgtagtggtcgtccaggaccatggccagccccctctctcggccaccgtcacactcactgtggctgtggccgacagcatcccagatgtcctggctgacttgggcagcctcaagccttcagcagacccagacgactcgggcctcacactctatctcgtggtggcagtggccgctgtctcctgcgtcttcctggcttttgtcacggtgctgctagcactcaagctgagacgctggcacaagtcacgcctgcttcacgctgaaggcagcaggttggcaggtgtgcctgcctcgcactttgtgggcgtggacggggttcgggctttcctgcagacctattcccacgaggtctccctcaccgcggactcgcggaagagtcacctgatcttctcccaacccagctatgcagacacgctcatcagccgggagagttgtgagaaaagcgagcctcttctgataactcaggatttacttgaaacaaaaggagaccctaatcttcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454930 - DNA, 4597 bp, Homo sapiens
atggcggctcagccgaggggcggggactacagaggattcttcctgctctccatcctcctggggaccccctgggaagcctgggcaggacgtattctctactccgtgtcggaggagacggacaaagggtcctttgtgggagacatcgccaaggacctggggctggagccccgggagctggcggagcgcggagtccgcatcatctccagaggtaggacgcagcttttcgccctgaaccagcgcagcggcagcttggtcactgcgggcaggatagaccgggaagagatctgcgctcagagtgcgcggtgtctggtaaactttaacatcctgatggaagataaaatgaatctttaccctatagacgtggaaataatagatattaatgacaacgttccaagattcttgacggaagaaataaatgtaaaaataatggagaatacagctcctggggttcggtttccgttaagcgaggctggggatccagatgtgggcacgaactccctccagagttaccagctcagccccaatcgccacttctccctggctgtgcaaagtggagacgatgaaactaagtacccggaactggtgctggagcgggtgctggaccgggaggaagagcgggttcaccacctggtcctcacagcctctgatggcggcgacccgccccgatccagcaccgcccacatccaggtgacagtggtggatgtgaatgaccacacgcctgtcttctctctgcctcagtaccaagtaactgtccccgagaatgtgccagtgggtacaagactgctcacggtacatgctatcgacctggacgagggagtcaatggggaagtgacatattcttttcggaaaataactcctaaacttccaaagatgtttcatctgaactcgcttacaggagaaatatcaactttagaaggattagattatgaagaaactgccttctatgaaatggaggttcaggctcaagatggtcctggtagtctgacaaaggcaaaagtactgatcacagttttagatgtaaatgataatgctccagaagtgactatgacgtctttaagtagctcaatccctgaagacacacctcttgggacagtcattgctcttttctacctacaagacagagattctggaaagaatggtgaggtgacctgcaccattccagaaaacctaccttttaaattagaaaaatcaatagataattattatagattggtcacaaccaaaaacttggaccgggaaacactctctttgtataacatcacactgaaagccacagatggtggaactcctcccttgtccagggaaactcacatattcatgcaggtggcagacaccaacgataacccacccaccttcccccactcatcctactcagtctacatcgctgagaacaaccccagaggggcctccattttcttagtgactgcacaggaccacgacagtgaggataatgcccagatcacttattccttggccgaagacaccatccagggggctccagtgtcctcctatgtctccataaactctgacactggagtcctgtacgcgctgcaatcctttgattatgagcagttgagagaactacaactaagagtgactgcacatgacagcggggacccgcctctcagcagcaacatgtcactgagcctgttcgtgctggaccagaatgacaacccgcccgagatcctgtacccggccctccccacagatggttctactggcatggagctggcaccccgctccgcagagcccggctacctggtgaccaaggtggtggcggtggacaaagattcaggccagaacgcctggctgtcatacctcctgcttaaggccagcgagccaggactctttgcggttgggctgtacacgggcgaggtgcgcacggctcgggccctgctggacagagatgccctcaagcagagcctcgtggtggccgtccaggaccacggtcagcctcctctgtcagccaccgtcacactcaccgtggctgtggctgacagcatccccgaagtcttggccgacctgggcagccttgagccctccgacggtccttacaactatgacctcacgttgtacctggtggtggcggtggccacagtctcctgcgtcttcctagccttcgtcctcgtactgctggcgctcaggctgcggcgctggcacaagtcacgcctgctgcaggcttcagaaggtggcttggcgaacgtgcccacctcgcactttgtgggcatggacggggtgcaggctttcctgcagacctattcccatgaggtctccctcaccgcggactctcggaagagtcacctgatcttcccccagcccaactatgtagacatgctcatcagccaggagagctgtgagaaaaatgattctttgctaacatccgtagattttcaggaatgtaaagaaaacctgccaagtattcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454931 - DNA, 4593 bp, Homo sapiens
atgaccaattgcctgagtttccgaaatggcagaggactggccctgctgtgcgcgctcctggggacgctgtgcgaaacaggatccggtcagatccgctactcggtgtctgaggagctagataaaggttccttcgtgggcaacatcgctaacgacctggggctagagccccgggagctggcggagcgcggagtccgcatcgtctccagaggtaggacgcagcttttctctctgaatccgcaaagcggcagcttggtcaccgcggagaggatagaccgggaggagctctgcgctcagatcccgctgtgtctggtaaaaattaacattctggttgaggataaattgaaaatttttgaagtagaaatagaaattaaagatattaatgataatgctcctaatttcccaacagaggaattggaaataaaaattggtgaactaacggttcctggaacccgatttccaattaaaactgcttttgacccagatgtaggcattaactccctgcagaactacaagcttagccccaatgactacttctctctggctgtgaatagcgtctctgagggggccaagtatccagagctggtgctggagcgggccctggaccgtgagaaaaaagaaattcaccagcttgtcctggttgcctctgatggtggcgaccctgtccactctggcaacttgcacatccaagtgatagtcctggatgcaaatgacaacccaccaatgtttactcagcctgagtaccgtgtgagtgtttgggagaacgtgcctgtgggtacccggctgctcacggtgaatgccactgaccctgacgagggattcaatgctcaagtgtcttatattctagataaaatgcctgggaaaatcgctgagattttccatcttaactcagtgagtggagaagtatcaatattaaaaagtctagattatgaggatgccatgttctatgaaattaaaattgaagcacaggatggaccaggtcttctttcaagagccaagattctagtcacggttctggatgtgaatgacaatgctccagaaattacaatcacgtctctcacaagctcagtcccagaagagggcaccgttggaagagaaattgctcttatcgacgtgcatgaccgagattctgggcagaatgggcaggttgaagtttttgtcctgggaaatctgccatttaagttagaaaaatcaatagatcaatattaccgcttagtgacggccacatccctggaccgcgaacaaatatcagaatataacattagtctgagagcctcagatgggggaagcccgccactgtccacagaaactcacatcaccctgcatgtgattgacatcaatgacaacccacccaccttccctcatttatcctactccgcctacattccagaaaacaaccccagaggagcctccatcttctcagtgacagcccaggacccagatagcaacaacaacgcccgcatcacttatgcattgaccgaggacactctccagggggcgcccctgtcctccttcgtctctatcaactccaacactggcgtcctatacgcgctgagatccttcgactacgagcaatttagagacttaaagctactggtgacagccagcgacagcgggaaccctccactcagcagcaacgtgtcgctgaacctgttcgtgctggaccagaacgacaacgcgcccgagatcctgtaccccgccctccccacagacggttccactggcgtggagctggcgcctcgctccgcagagcccggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagacgcgctcaagcagagcctcgtggtggccgtccaggaccacggccagccccctctctccgccactgtcacgctcaccgtggccgtggccgacaggatccccgacatcctggccgacctgggcagcctcgagccctccgccaaacccaacgattcggacctcactctgtacctggtggtggcggtggccgcggtctcctgcgtcttcctggccttcgtcatcgtgctgctggcgctcaggctgcggcgctggcacaagtcacgcctgctgcaggcttcgggaggcggcttggcgagtacgcccggctcgcactttgtgggcgcggacggggttcgggctttcctgcagacctattcccacgaggtctccctcactgcggactcgcggaagagccacctgattttcccccagcccaactatgcggacacgctcatcagccaggagagctgtgagaaaagcgagcctcttctgataactcaggatttacttgaaatgaaaggagattccaacctactcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454932 - DNA, 4570 bp, Homo sapiens
atggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacaagatttatactagaagtagcagaagatgcagatattggcttaaactctctgcagaagtataaactctctcttaacccaagtttctcattaataattaaggagaaacaggatggtagtaaatacccggaactggcactggagaaaaccttagaccgggaacaacagagttaccatcgtttagtcctgactgccttggacggtggacatccacccctaagcggcaccactgagctccggatccaggtaaccgacgccaatgataatcccccggtattcaaccgagacgtgtacagagtcagccttcgggaaaacgtgccaccaggcaccactgtgttgcaagtgtcagccactgaccaagacgagggcatcaactcagaaattacttattccttctacagaaccgggcaaatctttagtctgaattcaaagagcggagaaattaccactcaaaagaaactggattttgaagagaccaaggaatattcaatggttgtagaagggagggatggtggtggactggttgcacaatgtacagttgaaattaatattcaagatgaaaatgacaatagcccagaagttacattccattctctacttgaaatgattctggaaaacgcggtgcctggaacactaattgctttgatcaaaatacatgaccaagattctggggaaaatggggaggttaattgtcaattacaaggcgaagtcccttttaagattatctcttcatccaaaaattcgtataagttggtaacagatggaaccctagaccgagagcaaaccccggagtacaatgtcaccatcacagccacagacaggggcaagccgcccctctcctccagcataagcgtcatcctacatatcagagacgtcaacgataacgctccggttttccaccaggcgtcctacttagtcagtgtacccgaaaacaaccctcctggggcctccatcgcgcaagtctgcgcctcggacctggacttggggttgaacggccaagtctcctactctatcatggccagcgacctagagcctctggcactggcctcttacgtgtccatgagcgcgcaaagtggggtggtgttcgcgcagcgcgcctttgactacgagcagctgcgcaccttcgaactcacactacaggcccgcgaccagggctcgcctgcgctcagcgcaaacgtgagcctgcgcgtgttggtgggcgaccgaaacgacaacgcaccgcgggtgctgtaccccgcgctgggtcccgacggctctgcgctcttcgatatggtgccgcgcgctgcagagcccggctacctggtgaccaaggtagtggccgtggacgcagactcaggacacaacgcctggctgtcctaccacgtgctgcaggctagcgagcccgggctcttcagcctggggctgcgcacaggagaggtgcgcacagcgcgtgccttgggcgacagggacgcggcccgccagcgcctgctggttgctgtgcgtgatggtggacagccgccactctccgccaccgccacgctgcacttggtctttgctgacagcttgcaggaggtgctgccggatatcactgaccgccctgtaccctctgacccccaggctgagctgcagttttacctagtggtggccttggccttgatctcagtgctcttcctcctggccgtgattctggccgttgccttgcgcctgcgacgctcctccagccctgccgcctggagctgcttccaacctggtctctgtgtcaagtctggacctgtggttccccccaactacagtcaggggactttgccttattcctacaacctatgtgttgcacatacaggaaagacggagtttaatttcctaaaatgtagtgagcaattgagttcaggacaagacatactttgtggtgattcatctggggccttatttccactttgtaattccagcgagtcgacttcccatcctgagttgcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454933 - DNA, 4594 bp, Homo sapiens
atgaagattcagaaaaagctgactggctgcagcaggctgatgcttctgtgtctttctctggagctgctgttggaagctggggctgggaatattcactactcagtgccggaagagacagacaaaggttccttcgtaggcaacatcgccaaggacctagggctgcaaccccaggagctggcagatggcggagtccgcatcgtctccagaggtaggatgccgcttttcgctctgaatcctagaagtggcagcttgatcaccgcgcgcaggatagaccgggaggagctctgcgctcagagcatgccgtgtctcgtgagttttaatatccttgttgaggataaaatgaagctttttcctgttgaagtagaaataattgatattaatgacaacactccccaattccagttagaggaactggagtttaaaatgaatgaaataacgactccaggtaccagagtctcattgccttttgggcaagaccttgatgtgggtatgaactcactccagagctaccaactcagctctaaccctcatttctccctggatgtgcaacagggagccgatgggcctcaacatccagagatggtgctgcagagtcccttagacagagaagaagaagctgtccaccacctcatcctcacagcttctgatgggggtgaaccagtccgttcagggaccctcagaatttacattcaggtggtggatgcaaatgacaatcctccagcatttactcaggcacaataccatataaatgtccccgaaaacgtgccgctgggtactcagctgctcatggtaaatgccactgaccctgatgagggagccaatggggaagtaacgtactcctttcacaatgtagaccacagagtggcccaaatatttcgtttagattcttacacaggagaaatatcaaataaagaaccactagatttcgaagaatacaaaatgtattcaatggaagttcaagcccaggatggtgcggggctcatggctaaagttaaggtactgatcaaagttttggatgtaaatgataatgccccagaagtgaccatcacctctgtcaccactgcagttccagaaaactttcctcctgggaccataattgctcttatcagtgtgcatgaccaggactcaggagacaatggctacaccacatgtttcattcctggaaatttaccctttaaattggaaaagttagttgataattattaccgtttagtgactgaaagaacactggacagagaacttatctctgggtacaacatcacaataacagcaatagaccaaggaactccagctctatctactgaaactcacatttcactactagtgacagatatcaatgacaactccccagtcttccatcaggactcctactctgcctacattcccgaaaacaaccccagaggagcctccatcttctctgtgagggcccacgacttggacagcaatgagaatgcacaaatcacttactccctaatagaggacactatccagggggcacccctatctgcctacctctccatcaactccgacactggggtcctgtatgcgctgcgatccttcgactatgagcagttccgggacatgcaactgaaagtgatggcgcgggacagtggggatccgcccctcagcagcaacgtgtctctcagcctattcctgctggaccagaacgacaacgcgcccgagatcctgtaccccgccctccccacagatggttctaccggcgtggagctggcgcccctctccgcagagcccggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagacgcgctcaagcagagtctcgtggtggccgtccaggaccacggccagcccccgctctccgccactgtcacgctcaccgtggccgtggccgacaggatctccgacatcctggccgacctgggcagcctcgagccctccgccaaacccaacgattcggacctcactctgtacctggtggtggcggcggccgcggtctcctgcgtcttcctggccttcgtcatcgtgctgctggcgcacaggctgcggcgctggcacaagtcacgtctgctacaggcttcgggaggcggcttagcgagcatgcccggttcgcactttgtgggcgtggacggggttcgggctttcctgcagacctattcccacgaggtctccctcactgcggactcgcggaagagccacctgattttcccccagcccaactatgcggacacactcatcagccaggagagctgtgagaaaaagggttttctatcagcaccccagtctttacttgaagacaaaaaggaaccattttctcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454934 - DNA, 4588 bp, Homo sapiens
atgggaaatagctccggatggaggggcccagcagggcagaggcgaatgctatttctcttcctgctctctttgttagaccaggttctctccgaaccgatccgctacgctattcccgaggagctggacaggggctcgctggtagggaacctcgccaaggacctggggtttggcgtgggggatttacctactaggaacctgcgggttattgcagagaagaaattctttaccgtgagccccgaaaatgggaacttacttgtgagcgaccgtatagaccgagaggagatttgtggcaagaagtcgacgtgtgttctggaatttgaaatggttgctgaaaagcctttaaacttttttcatgtaactgtgctgatccaggatattaacgacaacccaccgacctttagccaaaatatcactgagctggaaatcagcgaactggctctcactggagccacatttgccctggaatctgcgcaagatcctgatgtaggtgtcaattcgctgcagcagtactacctcagccctgatccgcacttctctttgattcagaaggagaacctggatggcagtaggtacccagagctagtactgaaagcacccctggacagggaagagcagccacatcaccacctggtcctcacagctgtggatgggggcgagccctccagaagctgtaccacccagatcagggtaattgtcgcagatgcaaatgataaccccccagtatttactcaggacatgtacagggtcaatgttgcagagaacctgcccgctggctcctccgtattaaaagtgatggccattgacatggatgagggcatcaatgccgaaatcatctatgccttcatcaatattggcaaggaagtgagacaactgttcaagctggacagtaaaacgggggaactcaccactattggagaactggactttgaagagagagatagctacacaattggggtggaagcaaaggatggtggacatcacactgcatattgtaaagtacagatagatatttcagatgaaaatgacaatgccccggagataaccctggcttctgaatcccaacatatacaagaagatgctgagctggggactgccgttgccctgatcaaaacacatgatctagattctggatttaatggagaaatcctatgccaactaaaaggaaacttcccctttaaaatcgttcaagataccaaaaacacatacaggttggtgacagatggagccctggaccgggagcagatcccagaatacaatgtgacgatcacagctaccgacaaaggcaatccaccgctctcctccagcaagaccatcactctgcacatccttgatgtcaacgacaacgttcccgttttccaccaggcctcctacaccgtgcatgtagctgagaacaatccgcctggagcctccattgcgcatgtcagagcctcggatcccgacttgggacctaatggccttgtctcctactacatcgtggccagtgacctggagccgcgggagctgtcgtcctacgtgtccgtgagcgcgcggagcggggtggtgttcgcgcagcgagccttcgaccacgagcagctgcgtgccttcgagctcactctgcaggcccgcgaccagggctcgcctacgctcagcgccaacgtgagcctgcgcgtgttggtggacgaccgcaacgacaatgcaccgctggtgctgtacccagctctggggcccgaaggctctgcgctcttcgatatggtgccgcgctctgcagagcctggctacctggtgaccaaggtggtggcggtggacgcagactcgggatacaacgcctggctgtcctaccacattgtgcaggccagcgagcccgggctgttcagcctgggcctgcgcacgggtgaggtgcgcacggcgcgtaccttgggcgacagggaggccgcccgccagcgcctgctggtcactgtgcgtgatggaggacagcagcctctttcagccaccgtcatgctgcacctaatcttcgcagatagcttgcaagagatacaacctgaccttagcgaccgccccactccctctgaccctcaggcggagctacagtttcacctagtagtggcgttggccttgatctcagtgctcttcctcctcgcggtgattctggcaatctccctgcgcctgcgatgctcctccagacccgccactgagggctactttcagcctggtgtctgcttcaagactgtacctggagttctccccacctacagcgaaaggactttgccttattcctacaatccgtgtgctgcctcacattcctcaaacaccgagtttaaatttctcaatataaaggctgaaaatgctgcaccacaagatcttctatgtgatgaagcctcttggtttgaaagtaatgacaatccagaaatgccttctaattcaggcaatttgcaaaagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454935 - DNA, 4309 bp, Homo sapiens
agaatgggctctaggcgccgctgctcaccaatcagggaatgggaagctgcgcgccattgagtccctccctcccccgcctctaccacacaaagcggaatgagatggatactcacagatcctgacactggagacttagaagtattttccttcgctttctgatatattttggatgtagtcggcctaggacttcatagatacataagccgattcacaaccaaccagctcgagaaaccgcggaatatcggcttagagcctgccatggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccccgggagctggcgaagcgcggagtccgcatcgtctccagagggaagacacagcttttcgctgtgaatccgcgaagcggcagcttgatcacggcaggcaggatagaccgggaggagctctgtgagacggtgtcctcctgttttttaaatatggaacttctcgtggaagacaccttgaagatttacggagtggaggtggaaataatagatattaatgataacgcccccagcttccaggaggacgaagtggagataaaagtcagtgagcacgcaattcctggggcgcgatttgctcttcctaatgctagggatccagatgtgggcgtgaactccctccagagctaccagctcagccctaataattacttttccttgcaactgcggggcagaacggatggggccaagaatccagagctagtactggagggaagcctggaccgagagaaagaggctgctcacctgctcctcctcacagctttagatggaggcgatcccatccgaaagggcgcagttcccattcgtgtggtggtcctcgatgtaaatgatcacatcccaatgtttacacagtccgtatatcgcgtgagtgttccagaaaacatcagctccggaactcgggtgctgatggttaatgcaacggatccagacgagggaatcaacggggaagtaatgtattcatttcggaacatggaaagcaaggcttctgaaatattccaattggattcacaaactggagaagttcaagtacgggggtctctggattttgaaaaatatagattctatgagatggaaattcaaggccaagatggtggaggtctctttaccaccacgacgatgttgatcactgttgtggatgtgaatgataacgctccagaaataactatcacctcttctattaattcaattctggaaaactctcctccaggtacagtgattgctcttctaaatgtgcaagatcaagattctggagaaaatggtcaagtctcctgttttattcctaaccacctgccttttaaattagaaaagacttatggaaattattacaaattgataacaagcagagtgctggacagggagttggtccagagctacaatataacgttgacagccacagaccagggaagcccgcctttgtctgcagaaactcatgtctggctgaatgtggcagatgacaacgataaccctcccgtttttcctcactcctcttactctgcctacattcccgaaaacaaccccaggggtgcctccatcttctcagtgaccgccctcgacccggacagcaaacagaatgccctggtcacttactctctgacggatgacactgtccagggggtgcctctgtcctcctatgtctctattaactccaacactggtgttctctatgccctacaatccttcgactatgagcagtttcgagacttagaactgagagtgatagcacgtgacagcggggacccgcccctcagcagcaacgtgtcgctgagcctgttcgtgctggaccagaacgacaatgcgcccgagatcctgtaccctgccctccccacagacggctccactggcgtggagctggcgccccgctctgcggaacctggctacctggtgaccaaggtggttgcggtggacaaagattcaggccagaacgcctggctgtcctatcgcctgcttaaggccagcgagccgggactcttcgcggtgggggagcacacgggcgagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454936 - DNA, 2663 bp, Homo sapiens
aaagtgcccaggctacagagacaccctgaagccacagaaagacaaaggaaccggttgaaacacacaacgtgtccagtgaggactttgcagaattctgtaaccagactacaatggccgctcaaaggaatcgctcaaaggaatcaaaggattgcagcgggctggtcctgctctgccttttcttcgggattccatgggaggctggagcccggcagatctcctactcaattcctgaggaattagagaaaggctctttcgtgggcaacatctccaaggacttgggtctggcgccccgggagctggcggagcgcggagtccgcatagtctccagaggtaggacgcagcttttctctctgaacccgcgcagcggcagcttgatcaccgcgggcaggatagaccgggaggagctctgcgctcagagcgcgcggtgcgtggtgagttttaatatccttgtggaagacagggtgaaactttttgggatagaaatagaagtaactgatatcaatgacaatgctccaaaattccaagcagaaaatctagacgtaaaaattaatgaaaatgtcgctgcgggaatgcgttttcctctcccggaagctattgatccggatgtgggcgtgaactccctgcagagctatcagctcagccccaataagcacttctccctaagagttcagagccgtgccaatggcgtcaagtacccggagctggtactggagcactccctagatcgcgaggaagaggccattcaccacctggtcctcaccgcctccgacgggggtgaccctctccgatctggcactgtccttgtcagtgtgactgtcttcgatgcaaatgacaacgcgccggtcttcaccttgccagaataccgagtgagtgttcctgagaatttgcctgtgggcactcagctgctgacagtcacagccaccgacagggacgaaggtgccaatggagaagtgacatattcattccgaaaattacctgacacgcaattgttgaagttccaactaaacaaatatactggagaaataaaaatatcagaaaatctagattatgaagaaaccggtttctatgaaatagaaatacaagcagaagatggaggagcatatcttgcaactgcaaaagtgttgattacagtagaagatgtaaatgacaacagtccagagctgaccatcacgtctctatttagtccagtgactgaagattcacctctgggaacagtcgtagcccttttaaatgtgcatgatttagactctgagcagaatggacaggtaacctgttccattttggcgtatctaccatttaaattagaaaagtccattgacagttattacagattggtgatacacagagcccttgacagggaacaggtatcctcttacaatatcacagtgacagccacagatgggggaagtcctcctctatcaacggaagctcactttatgctacaagtggcagatatcaatgacaacccacctaccttctctcaagtctcctactttacctatatcccagagaacaacgccaggggtgcctccatcttctcagtgacagcgctggacccggacagcaaagagaatgcccagattatttactccctggctgaagacaccatccagggggtacctctgtcctcatacatatccatcaactcagacactggcgtcctgtatgcactcagatccttcgactatgagcagtttcatgagctacagatgcaggtgacagccagcgacagcggggatcctccactcagcagcaacgtgtcgttgagcctgtttgtgctggaccagaacgacaatgcgcccgagatcctgtaccccgccctccccacagacggttccacaggcgtggagctggcgccccgctccgcagagcccggctacctggtgaccaaggtggtggcggtggacagagactccggccagaacgcctggctgtcctaccgtctgctcaaggccagcgagccgggactcttcgcggtgggggagcacacgggcgaggtgcgcacggcgcgagccctgctggacagagacgcgctcaagcaaagcctcgtagtggccgtccaggaccacggccagccccctctctccgccactgtcacgctcaccgtggccgtggccgacagcatcccccaagtcctggcggacctcggcagcttcgagtctccagctaactctgaaacctcagacctcactctgtacctggtggtagcggtggccgcggtctcctgcgtcttcctggccttcgtcatcgtgctgctggcgcacaggctgcggcgctggcacaagtcacgcctgctgcaggcttcaggaggcggcttgacaggtgtgtccggctcgcactttgtgggcgtggacggggttcgggctttcctgcagacctattcccacgaggtctctctcaccgcggactcgcgaaagagtcacctgatcttcccccagcccaattatgcggacacgctcatcagccaggagagctgtgagaaaaacgatcctttgtctttgttagatgattcgaagtttcctatagaggataccccattggttccagtgagttttattttcatttttacttttgttaaaaaaaaaaagattggtttttactttgaagtttgcggcatgatggtggaaagtgtaaatgctaaaacactgatgagtagaatttga

SEQ ID NO: 454937 - DNA, 2735 bp, Homo sapiens
ctcccacacagaggctcccggctgcgcagaccttgcccagcacaccagattgccagctccgagacccgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtactatttcctttgctgctgcctttgttctaccccacgctgtgtgagccgatccgctactcgattccggaggagctggccaagggctcggtggtggggaacctcgctaaggatctagggcttagtgtcctggatgtgtcggctcgcgagctgcgagtgagcgcggagaagctgcacttcagcgtagacgcgcagagcggggacttacttgtgaaggaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaattccggaaagatgaaataaacttagaaatcagtgaatccgtcagcctggggatgggaacaattcttgagtctgcagaagatcctgatattagtatgaattcgctgagcaaataccaactaagtcctaacgagtatttctcattggtggagaaagacaatcctgatggtggcaaatatccagaattagtattgcagaagactctggaccgagaaacgcagagcgctcaccacttggtactgaccgccttagatggtggggaccctccccgaagcggtactgctcagataagaatcctggtaatagatgccaatgacaaccccccagtgttcagccaggacgtgtacagggttagccttcgggaagacgtgcctccaggcacctccatcctgagagtgaaggccactgaccaggacgagggcatcaactcagagatcacttattccttctttggtgtggctgacaaagctcagcacgtgttctctctggattacactacaggaaacattctaactcagcagcctttggattttgaagaagtagaaagatatacgataaacatagaagcaaaagaccgaggatctctctcaacacggtgtaaagtaattgtagaagttgtagacgaaaacgacaacagcccagaaataatcatcacgtcactctctgatcagattatggaggattcccctccaggagtggttgttgccctcttcaaaacacgggaccaagactcaggggaaaatggggaagtcaggtgtagcttaagtagaggtgttccatttaagattcattcttcttctaataattactacaagctagtaacagatgaggccctggatcgggagcagaccccagagtacaacgtcaccatcgcagccacagacaggggcaagcctccgttatcctccagcaaaaccataaccctgcacattactgacgtcaatgacaacgcgccggttttcggacagtcagcctacctggtccacgtgccagaaaacaaccagccgggtgcctccatagcgcaagtcagtgcctctgacccagacttcgggctcaacggccgtgtctcctactctctcattgccagcgacctggagtcacgaacgctgtcgtcctacgtgtccgtgagcgcgcagagcggggtggtgttcgcgcagcgcgccttcgaccacgagcagctgcgcaccttcgagctcacgctgcaggcccgcgaccagggctcgcccgcgctcagcgccaatgtgagcctgcgcgtgttggtgggcgaccgtaacgacaacgcaccgcgggtgctgtaccctgcgctgggtcccgacggctccgcgctcttcgacacagtgccgcgggccgcgcagccaggctacctggtgaccaaggtggtggccgtggacgcggactcggggcacaatgcctggctgtcctaccacgtggtgcaggccagtgagcccgggctcttcagcctggggctgcgaacaggcgaggtgcgcatggtgcgtgctttgggtgacaaggactcggtccgccagcgcctgctagtcgctgtaagagatggaggacagccacccctttcagccactgccacgctgcacctggtgttcgcagatagcttgcaagaggtactgccggatttcagcgaccatcccacaccctctgactcccaggctgagatgcagttttacctggtggtggccttggccttgatttctgtgctctttctcctcgcggtgattctagctattgctctacgcctgcgacagtctttcagccctactgcaggagactgctttgagtcagttctctgctccaagtccggacctgtgggtccccccaactacagtgagggaacgttgccctatgcctataatttttgtgtgcctggggatcaaatgaatccagaatttaattttttcacatctgttgatcattgtccagccacacaagataacctcaacaaagatagcatgctactggctagcattttaactcccagcgttgaagcagataagaagattcttaaacaggtaagtatttaaaaatgtatttaatcctttttatattacaatatgccaatatattccaatatagtggtattattttaagattctagataacttcttcatagagttcgcaaaatataggtcaaatttatggttatcattattaaaacaaaagttta

SEQ ID NO: 454938 - DNA, 3117 bp, Homo sapiens
agaatgggctctaggcgccgctgctcaccaatcagggaatgggaagctgcgcgccattgagtccctccctcccccgcctctaccacacaaagcggaatgagatggatactcacagatcctgacactggagacttagaagtattttccttcgctttctgatatattttggatgtagtcggcctaggacttcatagatacataagccgattcacaaccaaccagctcgagaaaccgcggaatatcggcttagagcctgccatggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccccgggagctggcgaagcgcggagtccgcatcgtctccagagggaagacacagcttttcgctgtgaatccgcgaagcggcagcttgatcacggcaggcaggatagaccgggaggagctctgtgagacggtgtcctcctgttttttaaatatggaacttctcgtggaagacaccttgaagatttacggagtggaggtggaaataatagatattaatgataacgcccccagcttccaggaggacgaagtggagataaaagtcagtgagcacgcaattcctggggcgcgatttgctcttcctaatgctagggatccagatgtgggcgtgaactccctccagagctaccagctcagccctaataattacttttccttgcaactgcggggcagaacggatggggccaagaatccagagctagtactggagggaagcctggaccgagagaaagaggctgctcacctgctcctcctcacagctttagatggaggcgatcccatccgaaagggcgcagttcccattcgtgtggtggtcctcgatgtaaatgatcacatcccaatgtttacacagtccgtatatcgcgtgagtgttccagaaaacatcagctccggaactcgggtgctgatggttaatgcaacggatccagacgagggaatcaacggggaagtaatgtattcatttcggaacatggaaagcaaggcttctgaaatattccaattggattcacaaactggagaagttcaagtacgggggtctctggattttgaaaaatatagattctatgagatggaaattcaaggccaagatggtggaggtctctttaccaccacgacgatgttgatcactgttgtggatgtgaatgataacgctccagaaataactatcacctcttctattaattcaattctggaaaactctcctccaggtacagtgattgctcttctaaatgtgcaagatcaagattctggagaaaatggtcaagtctcctgttttattcctaaccacctgccttttaaattagaaaagacttatggaaattattacaaattgataacaagcagagtgctggacagggagttggtccagagctacaatataacgttgacagccacagaccagggaagcccgcctttgtctgcagaaactcatgtctggctgaatgtggcagatgacaacgataaccctcccgtttttcctcactcctcttactctgcctacattcccgaaaacaaccccaggggtgcctccatcttctcagtgaccgccctcgacccggacagcaaacagaatgccctggtcacttactctctgacggatgacactgtccagggggtgcctctgtcctcctatgtctctattaactccaacactggtgttctctatgccctacaatccttcgactatgagcagtttcgagacttagaactgagagtgatagcacgtgacagcggggacccgcccctcagcagcaacgtgtcgctgagcctgttcgtgctggaccagaacgacaatgcgcccgagatcctgtaccctgccctccccacagacggctccactggcgtggagctggcgccccgctctgcggaacctggctacctggtgaccaaggtggttgcggtggacaaagattcaggccagaacgcctggctgtcctatcgcctgcttaaggccagcgagccgggactcttcgcggtgggggagcacacgggcgaggtgcgtacagcgcgggcactgctggacagagacgcgctcaagcagagcctcgtggtggccgtccaggaccacggccagccccctctctcggccaccgtcacgctcaccgtggctgtggccgacagcatccccgaagtcctggcggacctcggcagcctcgagtctctggctaactctgaaacctcagacctctcgctgtacttggtggtggcggtggccgcagtctcctgcatcttcctggtctttgtcatcgtgctgctggcactcaggctgtggcgctggcataagtcacgcctgctgcaggcttctgaaggcgggttggcaggtatgcccacgtcacattttgtaggcgtggacggggtacaggctttcctgcaaacctattcccacgaggtctctctcattgcggactcgcagaagagtcacctgattttcccccagcccaactatggggacacgctcatcagccaggagagctgtgagaaaagcgagccactcttgatagctgaagactcagctatcattttaggcaaatgtgacccgacaagtaatcaggtgagatttatttctctgcctcctaattgttggtgtcttggcacaagtcttttaaggagatgttttttgagcctgttatgaaaactgtttggggggggggtggggcggcatatatttagttcatatatatttagagcaatacatgtgagttttactttgcctttcatgagattacgataatctttcagaacgtttttgtgaaagtcatttttcaatcttggcatattttcttttgatttcaaaggggccattcaactatgctggtttggtttgaagtaagttgaattttagtattatttttctattatcagtgtatgaggctctcaatttattatatatagatacaaattaatgattcacaaacactttttatttccatttcaattttgctgtgccttcactgatttgtagttatattccaccatt

SEQ ID NO: 454939 - DNA, 2529 bp, Homo sapiens
atggcggcgcctcctgctcgcccagaccacacccggctgctccagatctgccttctcctgggggttctggtggaaatcagggccgaacagattctctactcggtgtttgaggagcaggaagaaggctcagtggtgggcaacatcgccaaggacctggggttggcgccccgggagctggcggagcgcggagtccgcatcgtctccagaggtaggacgcagcttttcgccctgaacccgcgcagcggcaccttggtcaccgcgggtaggatagacagggaggagctctgcgacagatctccaaactgtgtgacaaacctggagattcttctagaagatacagtgaagattttgcgggtagaggtggaaataatcgatgttaatgataacccacccagttttgggacagaacagagggaaataaaagttgctgaaaatgaaaatcctggggcaagatttcctcttcctgaagcttttgatccggatgtaggtgtaaactccctgcagggttaccagctcaactcaaacggttacttttccctggacgtgcaaagtggggccgatgggattaagtacccagagctggtgctggaacgcgctctagatcgcgaggaagaggcggttcaccacctcgttctcacggccttcgatggaggtgacccggttcgctctggcactgccaggattctcataatacttgtggataccaacgataatgctcccgtgttcactcagcccgagtaccacgtaagtgttcgtgagaacgttcctgtaggcactcggctactcaccgtaaaagccactgatccagatgaaggagccaatggagacgtgacgtattctttccggaaagtaagagacaaaatatcacagctatttcagttgaattctctgagtggggatataacaatattggggggtctagattatgaggactctggattctatgacatagatgtagaagcccatgatgggcctggtctccgagctagaagcaaggtactggtgacagttctggatgaaaatgacaacgcaccagaagtcacagttacatctctcaccagctcagtccaggaatcttcttccccgggtacagtaattgcacttttcaacgtgcatgacagtgactcaggaggaaatggcctagtcacatgttctattccagataatctgccattcacacttgaaaagacctatggaaattattatcggttgttgacacacagaacactggacagggaagaagtctcagaatataacatcactgtaactgccactgaccagggaactcctccactgtctacagaaactcatatttcactgcaagtgatggacatcaatgacaacccacccactttccctcatgcttcctactctgcttacattcctgaaaacaaccccagaggagcctccatcttatctatgactgctcaagaccctgacagtggtgacaatgcccgaatcacttactccctggccgaagacaccttccagggtgcacctctgtcctcctatgtctccatcaactccaatacagggatcctatatgctctttgctccttcgactatgagcagtttagagacctgcagctgctgatgacagccagtgacagtggagaccctccactcagcagcaatgtgtcactgagcctctttgtgctggaccagaacgacaatgtccctgagatcctgtaccccaccttccctactgatggctccactggtgtggagctggcaccccgctccgcagattccggctacctggtgaccaaagtggtggcagtggacagagactcaggtcagaatgcctggctgtcctacagcctactcaagtccagcgagccgggactatttgcagtggggctgcacacaggcgaggtgcgcaccgcacgggccctgctggacagagacgcgctcaagcagaggcttgtagtggtcgtccaggaccatggccagccccctctctcggccaccgtcacactcactgtggctgtggccgacagcatcccagatgtcctggctgacttgggcagcctcaagccttcagcagacccagacgactcgggcctcacactctatctcgtggtggcagtggccgctgtctcctgcgtcttcctggcttttgtcacggtgctgctagcactcaagctgagacgctggcacaagtcacgcctgcttcacgctgaaggcagcaggttggcaggtgtgcctgcctcgcactttgtgggcgtggacggggttcgggctttcctgcagacctattcccacgaggtctccctcaccgcggactcgcggaagagtcacctgatcttctcccaacccagctatgcagacacgctcatcagccgggagagttgtgagaaaagcgagcctcttctgataactcaggatttacttgaaacaaaaggagaccctaatcttcaggtgagtcaatcttataatagatcataccacactgaaatatagacaaagagttgtgtaaatgtctctcattttatatgtaatatatcaaataaagttgcctcttttaat

SEQ ID NO: 454940 - DNA, 2442 bp, Homo sapiens
atggcgagtccacctaggggctggggctgcggagagctgctgctgcccttcatgctcctggggacgctgtgcgagccaggatccgggcagatccgctactcgatgccggaggagctggacaaaggctccttcgtcggcaacatagccaaggaccttgggctggagccccaggagctggcggagcgcggagtccgcatcgtctccagaggtaggacgcagctttttgccctgaacccgcgaagcggcagcttggtcaccgcgggcaggatagaccgggaggagctctgcgctcagagcccactgtgtgtggtgaactttaacatcttggttgagaacaaaatgaaaatttatggagtagaagtagaaataatcgatattaatgataacttcccgcgtttccgggatgaagagttaaaagtaaaagttaatgaaaatgcggctgcagggacacggttagtgcttcccttcgcgcgggatgcggatgtgggtgtgaactctctccggagttaccagctcagctccaatctgcacttctctctggatgtggtaagcggaactgatggacaaaagtatccggagctggtgttggaacagcccctagaccgcgagaaagagactgttcacgacctcctcctcacagctttagatggcggagacccggtactctccggcaccacgcacatccgtgttacggtcctcgacgcaaacgacaatgcgcccctgttcaccccatccgagtacagcgtgagtgttccagagaacatacctgtgggcactcggctgctcatgctaaccgccacggatccagatgagggaataaacgggaaattgacctactcttttcgcaatgaagaagaaaaaatttcggagactttccaacttgattccaacctgggggaaatctcaactctacaatcactggactatgaagaatccagattctacctcatggaagtggtagctcaggatggaggcgctcttgttgccagcgctaaggtggtggtcacagtacaggacgtgaatgacaatgcccccgaagtgatcctcacctctctgaccagttcgatctctgaagactgtcttcccggaactgtaatcgcgctgtttagcgtacatgatggtgattctggagaaaatggtgagattgcatgctctattcctaggaatttgccttttaaattggagaagtcagttgataattactatcacctattaacaactagggacctggacagagaagagacttcagattataatatcactttaaccgtcatggaccatggaaccccgcccctctctacagaaagccacatccccttgaaagtagcagacgttaatgacaacccacccaatttccctcaagcctcctactccacctctgtcacagaaaacaatcccagaggtgtctctatcttctctgtgacagcccatgaccccgacagcggcgacaacgctcgagtcacctactccctggctgaagacacatttcagggggcgcccttgtcctcctatgtatccattaactctgacaccggtgtcctgtatgctctgagatccttcgactatgagcagttgagagacctacagttgtgggtgacagccagcgacagtgggaaccctccacttagcagcaacgtgtcgctgagcctgtttgtgctggaccagaacgacaatacgcctgagatcctgtaccccgccctccccacagacggttccacgggcgtggagctggcgcctcgctccgcagaacctggctacctggtgaccaaggtggtagcggtggacaaagattcaggccagaacgcctggctgtcctaccgcctgcttaaggccagcgagccaggactctttgcggttgggctgcacacgggcgaggtgcgcacagcgcgagccctgctggacagagacgcgctcaagcagagcctcgtggtggccgtcgaagaccatggccagccccctctgtcagccaccttcacggtcaccgttgccgtggccgacaggatccctgacatcctggctgacctaggcagtatcaagacccccattgaccctgaggatctggacctcacactctatcttgtggtggcagtggctgcagtctcctgcgtcttcctggccttcgtcatcgtgctgctggtgctcagactgaggcgctggcacaagtcacgcctgcttcaggctgaaggcagcaggttggcgggtgtgcccgcctcgcactttgtgggcgtggatggggttcgggctttcctgcagacctattcccacgaggtctccctcaccgcggactcgaggaagagtcacctgatctttccccagcccaactacgcagacacgctccttagtgaagagagctgtgagaaaagcgagcctcttctgatgtctgataaggtagatgcaaacaaagaagaacggcgagttcaggttagttttctctttcggtaa

SEQ ID NO: 454941 - DNA, 2637 bp, Homo sapiens
atggggcccaagacactcccacagctcgctgggaaatggcaagtgctgtgcatgttgtccttgtgctgctggggctgggtgtctgggcagcttcgttactcagtggtggaggagtctgagccggggacgctggtggggaatgttgctcaggatctgggcttaaagatgacagatctgttgagccggcggctgcaattgggctctgaggagaatgggcgctatttttccctgagcttgatgagtggtgccctggcagtgaatcaaaagattgaccgagaaagcctatgtggagccagcaccagctgcctgctgccagtgcaggtggtgactgaacaccccctggagctaatccgtgtagaggtagagatcctggatctcaatgacaactctcctagctttgccacccctgagcgagagatgcgcatctcagaatcagcagcatctggggcacgattcccactggacagtgcccaggatccggatgtgggcaccaatactgtgagcttttacactctaagccccaacagccacttctctctgaatgtgaagaccctaaaagatgggaagccattcccagagctggtgctagagcagcagctggatcgtgaagcccaggcaagacatcagctggtgcttactgctgtggatggggggaccccagcccgctcagggaccacccttatctctgtcatcgtgctggacatcaatgataatgctccaaccttccaatcctcagttctacgtgtgggaatcccagagaatgcacccattggtactctgctgctccgcctcaatgccactgatccagacgagggcaccaacggccaactagactattcttttggagaccacacatctgaggcagtgcggaacctctttggcctagaccctagcagtggggcaatccatgtgttgggtcccatagactttgaggagtcacgtttctatgaaattcatgcaagagcccgtgaccagggacagcctgccatggagggccactgtgtgattcaagtggatgtgggggatgtcaatgacaatgccccagaggtgctattggcctctttggccaaccctgtcctagagagcacaccagtgggcacagtagtggggttgtttaatgtgcgagaccgggactcaggtagaaatggtgaagtgagccttgatatctctccggacctgccatttcagattaagccttctgagaaccactactcgctgctaaccagccagcctttggaccgggaggccacatcccactatatcatcgagctgctggccagcgatgctggttcaccttccctacacaaacatctcaccatcaggctcaacatttcagatgtcaatgacaatgcaccccgcttcaaccagcagctttacactgcttacatcctagaaaaccggcctccgggctcccttctttgcactgtggctgcctcagatccagacactggggataatgcccgcctcacctactccattgtaggaaatcaggttcagggagccccagcctcctcctttgtgtatgtcaacccagaggatggacggatctttgcccagcgtacctttgactatgaattgctgcagatgctgcagattgtggtgggggttcgagactccggctctcccccattgcatgccaacacatctctgcatgtgtttgtcctagacgagaatgataatgccccagctgtgctgcacccacggccagactgggaacactcagccccccagcgtctccctcgctctgctcctcctggctccttggtcaccaaggtgacagccgtggatgctgatgcaggccacaatgcgtggctctcctactcactgttgccacagtccacagccccaggactgttcctcgtgtctacacacactggtgaggtgcgcacagcccgggccttactggaggatgactctgacacccagcaggtggtggtcctggtgagggacaatggtgacccttcactctcctccacagccacagtgctgctggttctggaggatgaggaccctgaggaaatgcccaaatccagtgacttcctcatacaccctcctgagcgttcagaccttaccctttacctcattgtggctctagcgaccgtcagtctcttatccctagtcaccttcacctttctgtcagcgaagtgccttcagggaaacgcagacggggacgggggtggagggcagtgctgcaggcgccaggactcaccctccccggacttctataagcagtccagccccaacctgcaggtgagctcggacggcacgctcaagtacatggaggtgacgctgcggcccacagactcgcagagccactgctacaggacgtgcttttcaccggcctcggacggcagtgacttcacttttctaagacccctcagcgttcagcagcccacagctctggcgctggagcctgacgccatccggtcccgctctaatacgctgcgggagcggagccaggtgaggggctcggcgccgccccgggcgacccctgggggcggcactggagaagccgcccgtcctcataagggattgaacttgcatccactcctctccggccggcttggtcgctggctgcgctccacccgattctcgggatcattggaccgtttgcgcgaaaccagagtggccgattaa

SEQ ID NO: 454942 - DNA, 2487 bp, Homo sapiens
atggcagctccaaccaaatgccagctccgcggaagattagtcctgctatgctcgctcctggggatgctatgggaggccagggccagtcagattcgctactcagtgcctgaagagacagaaaagggctatattgtgggcaacatctccaaggacctggctctggagccccgggagctggcggagcgccgagtccgcatcgtctctagaggtaggacgcagcttttctctctgaacccgcgcagcggcaccttggtcaccgcgggtaggatagaccgggaggagctctgtgctcagagcccgcggtgtctggtgaactttaaagtcctggttgaagacagagtgaaactgtacggaatagaaatagaagtaactgatattaacgacagcgccccaaagttccaggccgaaagtctggaagtaaaaattaacgaaatcgcggttcctggagcacgttatccacttccagaagctattgatccggatgttggcgtgaactccctccagagctaccagctcagccccaatcaccacttctccctgaacgtgcagactggagacaatggagccataaacccagagctggtgctggagcgcgccctggacagggaggaggcaactgcccaccacctggtcctcacggcctcggatggcggcgagccgcgtcgctccagcacagtgcgcatccatgtgacagtgttggatacaaatgataatgccccggtttttgctcaacggatttaccgagttaaagtccttgagaacgtgcccccaggcacctggctgcttactgcaacagccagcgacctggatgagggaatcaacggaaaagtggcatacaaattctggaaaattaatgaaaaacaatctctgctattccagcttaatgaaaatactggggaaatatcaacagcaaaaagtctagattatgaagaatgttcattttatgaaatggaaatacaagctgaagatggtgggggattgaaagggtggacaaaagtgctcatttcggtggaagatgtaaatgacaatagacctgaagtgaccattacatctctgtttagcccagtgagagaagacgcacctcagggaacagtaattcttcttttcaatgctcatgaccgagactccgggaagaatggtcaagttgtctgttctatccaggagaatctatcttttacattagaaaattcagaagaagattattacagattgttgacggcccaaattcttgaccgagaaaaagcctcagaatataatatcacggtgactgcaacagacagaggaactccgcccctgtccacagaaattcacatcaccctgcaagtgactgacatcaatgataatccacctgctttctctcaagcctcctactcagtctacctcccggaaaacaacgccagaggtacttccatcttctccgtgattgcctatgaccctgatagcaatgagaattctagagttatttactccttggcagaggataccatccaagggtctcctctctccacctatgtctctattaactcagacactggtgtgctgtatgctctgtgctcctttgactatgagcagtttagagatttgcaaatgcaggtgacggcaagtgacagtggaagcccaccacttagcagcaatgtgtcattgagactgtttgttttggaccagaatgacaatgccccagaaatcctgtaccctgccctccccactgatggttctactggtgtggagctggcaccccgctctgcagagcctggctacctggtgaccaaggtggtggcagtggacagagactcaggccagaatgcttggctctcctaccgcctattcaaggccagtgagccagggctcttctcggtggggctgcacacaggtgaagtgcgcacagctcgggccctgctagatagagatgcgctcaaacagagccttgtggtggctgtacaggaccatggccagccccctctctcggccactgtcacgctcacagtagccatagctgacagcatcccagacatcctggctgacctgggcagtcttcagatccctgcagacctggaggcctcagaccttaccctctacctcgttgtggctgtggcagtcgtctcctgtgtcttcctcaccttcgttatcacgctgctggccctcaggctgaggcactggcactcctcgcatctgctgcgggctaccagtgatgggttggctggtgtgcccacctcacactttgtgggtgtagatggggttcgagctttcctacagacctattctcaggagttctccctcaccgctgactcaaggaagagtcacctgatcttcccccagcccaactatgcagacacactcatcagccagcagagctgtgagaaaaatgagcctttgtgcgtctctgttgattccaagtttcctatagaagacacccctttggttccggtgagttcattttttttctttctttcttttctttttttgttttttgttttgttttgtttttga

SEQ ID NO: 454943 - DNA, 2433 bp, Homo sapiens
atgcagagagccagagaagccgaaatgatgaaaagtcaggtactgtttcccttcctgctgtctttgttctgcggggccatctcccagcagatccgatacacgattccagaggagctagccaacggctcacgggtggggaaacttgccaaggatctggggctcagtgtccgggagttgccaactcgaaaactgcgggttagtgcagaggattatttcaacgttagtttggagagcggggatttgttagtgaacggtaggatagatcgagagaagatttgcggaaggaaacttgagtgtgcactagaattcgaaacggtcgctgaaaacccaatgaatgttttccacgtggttgttgtaatccaagatattaatgacaatgcaccacgtttcgttgcaaaaggcattgacttagaaatttgtgagtcagccttacccggggtaaaattctctctggattctgctcaagatgcagatgtggaaggcaattcactgaagttatacaccatcaaccccaatcaatacttctctctgtcaacgaaggaaagtcctgatggaagtaaatatccggtattactgctggaaaaacctctagacagggaacatcagagctctcatcgcttaatcctgactgccatggatggcggggacccgcctctaagcggcaccacccatatctggatccgagttacggatgccaatgataatgctcccgtgtttagccaggaggtatacagggttagcctccaagaaaacgtaccgtggggaacctccgtgctgcgggtgatggccacagaccaggatgagggcattaatgcagagatcacctatgccttcctcaattccccaataagtaccagcctcttcaatctcaatccaaatactggcgacatcacaaccaatggcacattggattttgaagagacaagtagatatgtgttgagtgtggaagctaaggatggaggagtacacacagctcactgtaatgttcaaatagaaattgttgacgagaatgacaatgccccagaggtgacattcatgtccttctctaaccagattccagaggattcagaccttggaactgtaatagccctcataaaagtgcgagacaaggattctgggcaaaatggcatggtgacatgctatactcaggaagaagttcctttcaaattagaatccacctcgaagaattattacaagctggtgattgctggagccctaaaccgggagcagacagcagactacaacgtcacaatcatagccaccgacaagggcaaaccagccctttcctccaggacaagcatcaccctgcacatctccgacatcaacgacaatgcacctgttttccatcaggcctcctatgtggtccacgtgtctgagaacaacccacctggcgcctccattgcacaagtaagcgcctccgacccggatttgggacccaacggcagagtctcctactctattctggccagtgacctggagccgcgggagctgttgtcctacgtgtccgtgagcccgcagagcggggtggtgttcgcgcagcgcgccttcgaccacgagcagctgcgcgccttcgagctcacactgcaggccagggaccagggctcccccgcgctcagcgccaacgtgagcctgcgcgtgttggtgggcgacctcaatgacaatgcgccacgggtgctgtaccccgcgctggggcctgatggctccgccctcttcgatatggtgccacgcgccgcagagcccggctacctggtgaccaaggtggtggcggtggacgcagactcaggacacaacgcttggctgtcctaccacgtgctgcaggccagcgagcccgggctcttcagcctggggttgcgcacgggtgaggtgcgcacagcgcgtgccttgggcgacagggacgcggcccgccagcgcctgctggtcgctgtgcgtgatggaggacagccgccactctccgccaccgccacgctgcacctaatcttcgcggatagcctgcaagaggtattgccagacctcagcgaccgccctgagccctctgacccccagacggaactgcagttttacctggttgtggccttggccttgatctcagtgctctttctcctcgcggtgattctagcgatcgccctgcgcctgcgacgttcctccagcctcgacactgagggctgctttcaaaccggtctctgctccaagtctgggcccggggttcctcccaaccacagcgaggggactttgccctattcctacaatctatgtattgcctctcattctgcaaagacagagtttaattctctcaacctgacaccggaaatggctccccctcaggatctgctgtgtgatgatccttctatggttgtatgtgccagtaatgaagatcacaaaatcgcttatgacccttctttgtcttcgcacgtgagtttctgcaaatctagttaa

SEQ ID NO: 454944 - DNA, 2472 bp, Homo sapiens
atgaagattcagaaaaagctgactggctgcagcaggctgatgcttctgtgtctttctctggagctgctgttggaagctggggctgggaatattcactactcagtgccggaagagacagacaaaggttccttcgtaggcaacatcgccaaggacctagggctgcaaccccaggagctggcagatggcggagtccgcatcgtctccagaggtaggatgccgcttttcgctctgaatcctagaagtggcagcttgatcaccgcgcgcaggatagaccgggaggagctctgcgctcagagcatgccgtgtctcgtgagttttaatatccttgttgaggataaaatgaagctttttcctgttgaagtagaaataattgatattaatgacaacactccccaattccagttagaggaactggagtttaaaatgaatgaaataacgactccaggtaccagagtctcattgccttttgggcaagaccttgatgtgggtatgaactcactccagagctaccaactcagctctaaccctcatttctccctggatgtgcaacagggagccgatgggcctcaacatccagagatggtgctgcagagtcccttagacagagaagaagaagctgtccaccacctcatcctcacagcttctgatgggggtgaaccagtccgttcagggaccctcagaatttacattcaggtggtggatgcaaatgacaatcctccagcatttactcaggcacaataccatataaatgtccccgaaaacgtgccgctgggtactcagctgctcatggtaaatgccactgaccctgatgagggagccaatggggaagtaacgtactcctttcacaatgtagaccacagagtggcccaaatatttcgtttagattcttacacaggagaaatatcaaataaagaaccactagatttcgaagaatacaaaatgtattcaatggaagttcaagcccaggatggtgcggggctcatggctaaagttaaggtactgatcaaagttttggatgtaaatgataatgccccagaagtgaccatcacctctgtcaccactgcagttccagaaaactttcctcctgggaccataattgctcttatcagtgtgcatgaccaggactcaggagacaatggctacaccacatgtttcattcctggaaatttaccctttaaattggaaaagttagttgataattattaccgtttagtgactgaaagaacactggacagagaacttatctctgggtacaacatcacaataacagcaatagaccaaggaactccagctctatctactgaaactcacatttcactactagtgacagatatcaatgacaactccccagtcttccatcaggactcctactctgcctacattcccgaaaacaaccccagaggagcctccatcttctctgtgagggcccacgacttggacagcaatgagaatgcacaaatcacttactccctaatagaggacactatccagggggcacccctatctgcctacctctccatcaactccgacactggggtcctgtatgcgctgcgatccttcgactatgagcagttccgggacatgcaactgaaagtgatggcgcgggacagtggggatccgcccctcagcagcaacgtgtctctcagcctattcctgctggaccagaacgacaacgcgcccgagatcctgtaccccgccctccccacagatggttctaccggcgtggagctggcgcccctctccgcagagcccggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagacgcgctcaagcagagtctcgtggtggccgtccaggaccacggccagcccccgctctccgccactgtcacgctcaccgtggccgtggccgacaggatctccgacatcctggccgacctgggcagcctcgagccctccgccaaacccaacgattcggacctcactctgtacctggtggtggcggcggccgcggtctcctgcgtcttcctggccttcgtcatcgtgctgctggcgcacaggctgcggcgctggcacaagtcacgtctgctacaggcttcgggaggcggcttagcgagcatgcccggttcgcactttgtgggcgtggacggggttcgggctttcctgcagacctattcccacgaggtctccctcactgcggactcgcggaagagccacctgattttcccccagcccaactatgcggacacactcatcagccaggagagctgtgagaaaaagggttttctatcagcaccccagtctttacttgaagacaaaaaggaaccattttctcaggtaaacttttgtgatgaatgtatcagctatctagagaaaaataattcttga

SEQ ID NO: 454945 - DNA, 2457 bp, Homo sapiens
atggcgcctccgcagaggcatccgcagcgcagcgagcaggtcctgctcctcacgctcctggggacgctgtggggggccgcggcagcgcagatccgctactctattcccgaggagctggagaaaggctccttcgtaggcaacatcgtcaaggatctgggactggagccccaggagttggcggagcacggagtccgcatcgtctccagaggtaggatgcagcttttctctctgaatccgcgaaacggcagcttggtcaccgcgggtaggatagaccgcgaggagctctgtgctcagagcccgcggtgtctggtgagttttaacatccttgtcgaggataaactgaatctttatcccgtggaagtggaaatagtggacattaatgacaatacaccccgattcttaaaggaagaattggaagtgaaaattctcgaaaacgcagctccatcctctcgttttccactaatggaggtctatgaccctgatgtgggaatgaactcccttcagggatttaagctcagtggtaatagtcacttctcagtggacgtgcaaagcgaagcccatgggcccaagtacccggagctggtgctggagggcacactggaccgggaaggagaagccgtttaccgcctggtccttactgccatggatggcggcgaccctgtccgctcaagcgtcgcccaaattctggtaacagttctagatgtgaatgacaacactccaatgtttactcagcctgtctaccgtgtaagtgttcctgaaaacctgccagtaggcacaccagtgttggcagtgactgccaccgaccaggatgaaggagtccacggggaagtaacttattcctttgtgaagattacagaaaagatctcacaaattttctgtttgaatgttttgactggagaaatttcaacttctgcaaatctagactatgaggactcgagtttttatgagctgggtgttgaagcccgggatgggccaggtcttcgagacagagcgaaagtcttaataactatcttggatgtcaatgataatgtaccagaagtggttgttacatctggaagcagaacaattgctgaaagtgcacctccaggaacagtaatcgccctttttcaagtgttcgatcgagactctggcctgaatggcctggtaacctgttccatcccgagaagtctcccatttgaattggaaaaatcagttggcaattattatcgattagtgacaaatgcagctctagaccgggaagaggtattcttgtacaacatcactgtgacagccacggacaaaggaacaccacctctgtctacagaaacaatcatctctctaaatgtggcagacaccaacgacaacccgcccaccttcccccattcatcctactcagtctatgtccttgaaaacaaccccaggggtgcctccatcttctctgtgaatgcactggaccctgacgtggaccagaacgcccaagtctcctactcactggcagaagacaccctccagggggcgcccctgtcctcctacgtgtccatcaactccgacactgggattctgtacgccctgcgctccttcgactatgagcagttgagagacctacagctgtgggtgacagccagcgacagcggggacccgcctcttagcagcaacgtgtcactgagcctgtttgtgctggaccagaatgacaatgcgcccgagatcctgtaccccgccctccccacagacggttccactggcgtggagctggcgccccgctccgcagagcccggctacctggtgaccaaggtggtggcggtggacagagactcgggccagaacgcctggctgtcctaccgcctgctcaaggccagcgagccaggacttttctcagtgggcctgcacacgggcgaggtgcgcacggcgcgcgccctgctggacagagacgcgctcaagcagagcctagtggtggccgtccaggaccacggccagccccctctctccgccactgtcacgctcaccgtggccgtggccgacaggatccccgacatcctggccgacctgggcagcctcgagccctccgccaaacccaacgattcggacctcactctgtacctggtggtggcggtggccgcggtctcctgcgtcttcctggccttcgtcatcgtgctgctggcgctcagactgcagcgctggcacaagtcacgcctgctgcaggcttcgggaggtggcttagcgagcatgcccggctcgcactttgtgggcgtggaaggggttcgggctttcctgcagacctattcccacgaggtctcactcactgcagactcgcgtaagagtcatctgattttcccccagcccaactatgccgacacgcttatcaaccaggagagctatgagaaaagcgagcctcttctgataactcaggatttacttgaaacgaaaggagaacccaggcaacttcaggtgagtttctttccgcctaagcgggaagagtaa

SEQ ID NO: 454946 - DNA, 1537 bp, Homo sapiens
atggggcccaagacactcccacagctcgctgggaaatggcaagtgctgtgcatgttgtccttgtgctgctggggctgggtgtctgggcagcttcgttactcagtggtggaggagtctgagccggggacgctggtggggaatgttgctcaggatctgggcttaaagatgacagatctgttgagccggcggctgcaattgggctctgaggagaatgggcgctatttttccctgagcttgatgagtggtgccctggcagtgaatcaaaagattgaccgagaaagcctatgtggagccagcaccagctgcctgctgccagtgcaggtggtgactgaacaccccctggagctaatccgtgtagaggtagagatcctggatctcaatgacaactctcctagctttgccacccctgagcgagagatgcgcatctcagaatcagcagcatctggggcacgattcccactggacagtgcccaggatccggatgtgggcaccaatactgtgagcttttacactctaagccccaacagccacttctctctgaatgtgaagaccctaaaagatgggaagccattcccagagctggtgctagagcagcagctggatcgtgaagcccaggcaagacatcagctggtgcttactgctgtggatggggggaccccagcccgctcagggaccacccttatctctgtcatcgtgctggacatcaatgataatgctccaaccttccaatcctcagttctacgtgtgggaatcccagagaatgcacccattggtactctgctgctccgcctcaatgccactgatccagacgagggcaccaacggccaactagactattcttttggagaccacacatctgaggcagtgcggaacctctttggcctagaccctagcagtggggcaatccatgtgttgggtcccatagactttgaggagtcacgtttctatgaaattcatgcaagagcccgtgaccagggacagcctgccatggagggccactgtgtgattcaagtggatgtgggggatgtcaatgacaatgccccagaggtgctattggcctctttggccaaccctgtcctagagagcacaccagtgggcacagtagtggggttgtttaatgtgcgagaccgggactcaggtagaaatggtgaagtgagccttgatatctctccggacctgccatttcagattaagccttctgagaaccactactcgctgctaaccagccagcctttggaccgggaggccacatcccactatatcatcgagctgctggccagcgatgctggttcaccttccctacacaaacatctcaccatcaggctcaacatttcagatgtcaatgacaatgcaccccaccacaatctgcagcatctgcagcaattcatagtcaaaggtacgctgggcaaagatccgtccatcctctgggttgacatacacaaaggaggaggctggggctccctgaacctgatttcctacaatggagtaggtgaggcgggcattatccccagtgtctggatctgaggcagccacagtg

SEQ ID NO: 454947 - DNA, 4462 bp, Homo sapiens
  misc_feature (1)..(1): n is a, c, g, or t
nctacgtaccatttcatagcttgattcctagagtaaaacgcattactgctcctagcgcgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattgcaaagtgttggtggaggttgtggatgtgaatgacaacgccccggagatcacagtcacctccgtgtacagcccagtacccgaggatgcccctctggggactgtcatcgctttgctcagtgtgactgacctggatgctggcgagaacgggctggtgacctgcgaagttccaccgggtctccctttcagccttacttcttccctcaagaattacttcactttgaaaaccagtgcagacctggatcgggagactgtgccagaatacaacctcagcatcaccgcccgagacgccggaaccccttccctctcagcccttacaatagtgcgtgttcaagtgtccgacatcaatgacaaccctccacaatcttctcaatcttcctacgacgtttacattgaagaaaacaacctccccggggctccaatactaaacctaagtgtctgggaccccgacgccccgcagaatgctcggctttctttctttctcttggagcaaggagctgaaaccgggctagtgggtcgctatttcacaataaatcgtgacaatggcatagtgtcatccttagtgcccctagactatgaggatcggcgggaatttgaattaacagctcatatcagcgatgggggcaccccggtcctagccaccaacatcagcgtgaacatatttgtcactgatcgcaatgacaatgccccccaggtcctatatcctcggccaggtgggagctcggtggagatgctgcctcgaggtacctcagctggccacctagtgtcacgggtggtaggctgggacgcggatgcagggcacaatgcctggctctcctacagtctcttgggatcccctaaccagagcctttttgccatagggctgcacactggtcaaatcagtactgcccgtccagtccaagacacagattcacccaggcagactctcacggtcttgatcaaagacaatggggagccttcgctctccaccactgctaccctcactgtgtcagtaaccgaggactctcctgaagcccgagccgagttcccctctggctctgccccccgggagcagaaaaaaaatctcaccttttatctacttctttctctaatcctggtttctgtggggtttgtggtcacagtgttcggagtaatcatattcaaagtttacaagtggaagcagtctagagacctataccgagccccggtgagctcactgtaccgaacaccagggccctccttgcacgcggacgccgtgcggggaggcctgatgtcgccgcacctttaccatcaggtgtatctcaccacggactcccgccgcagcgacccgctgctgaagaaacctggtgcagccagtccactggccagccgccagaacacgctgcggagctgtgatccggtgttctataggcaggtgttgggtgcagagagcgcccctcccggacagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454948 - DNA, 4381 bp, Homo sapiens
tatgggggggagaataattgactaggtacgatggctcggttttaatcgtgcacggggtgtcggactcggcgcccagcgcccaagcgctaacccgctgaaagtttctcagcgaaatctcagggacgatctggaccccgctgagaggaactgcttttgagtgagatggtcccagaggcctggaggagcggactggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattgcaaagtgttggtggaggttgtggatgtgaatgacaacgccccggagatcacagtcacctccgtgtacagcccagtacccgaggatgcccctctggggactgtcatcgctttgctcagtgtgactgacctggatgctggcgagaacgggctggtgacctgcgaagttccaccgggtctccctttcagccttacttcttccctcaagaattacttcactttgaaaaccagtgcagacctggatcgggagactgtgccagaatacaacctcagcatcaccgcccgagacgccggaaccccttccctctcagcccttacaatagtgcgtgttcaagtgtccgacatcaatgacaaccctccacaatcttctcaatcttcctacgacgtttacattgaagaaaacaacctccccggggctccaatactaaacctaagtgtctgggaccccgacgccccgcagaatgctcggctttctttctttctcttggagcaaggagctgaaaccgggctagtgggtcgctatttcacaataaatcgtgacaatggcatagtgtcatccttagtgcccctagactatgaggatcggcgggaatttgaattaacagctcatatcagcgatgggggcaccccggtcctagccaccaacatcagcgtgaacatatttgtcactgatcgcaatgacaatgccccccaggtcctatatcctcggccaggtgggagctcggtggagatgctgcctcgaggtacctcagctggccacctagtgtcacgggtggtaggctgggacgcggatgcagggcacaatgcctggctctcctacagtctcttgggatcccctaaccagagcctttttgccatagggctgcacactggtcaaatcagtactgcccgtccagtccaagacacagattcacccaggcagactctcacggtcttgatcaaagacaatggggagccttcgctctccaccactgctaccctcactgtgtcagtaaccgaggactctcctgaagcccgagccgagttcccctctggctctgccccccgggagcagaaaaaaaatctcaccttttatctacttctttctctaatcctggtttctgtggggtttgtggtcacagtgttcggagtaatcatattcaaagtttacaagtggaagcagtctagagacctataccgagccccggtgagctcactgtaccgaacaccagggccctccttgcacgcggacgccgtgcggggaggcctgatgtcgccgcacctttaccatcaggtgtatctcaccacggactcccgccgcagcgacccgctgctgaagaaacctggtgcagccagtccactggccagccgccagaacacgctgcggagctgtgatccggtgttctataggcaggtgttgggtgcagagagcgcccctcccggacagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454949 - DNA, 2345 bp, Homo sapiens
gccacgcgtacgcccacgcgatctgccactgctgtcgtgtcggactcggcgcccagcgcccaagcgctaacccgctgaaagtttctcagcgaaatctcagggacgatctggaccccgctgagaggaactgcttttgagtgagatggtcccagaggcctggaggagcggactgcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454950 - DNA, 2498 bp, Homo sapiens
gccacgcgtacgcccacgcgatctgccactgctgtcgtgtcggactcggcgcccagcgcccaagcgctaacccgctgaaagtttctcagcgaaatctcagggacgatctggaccccgctgagaggaactgcttttgagtgagatggtcccagaggcctggaggagcggactggtgtatctcaccacggactcccgccgcagcgacccgctgctgaagaaacctggtgcagccagtccactggccagccgccagaacacgctgcggagctgtgatccggtgttctataggcaggtgttgggtgcagagagcgcccctcccggacagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454951 - DNA, 9913 bp, Homo sapiens
  misc_feature (9723)..(9723): n is a, c, g, or t
  misc_feature (9734)..(9736): n is a, c, g, or t
  misc_feature (9745)..(9747): n is a, c, g, or t
cagggcagccccagctcagactccccagcgccagcctttacaccgcttcctcctcggaaaaagaagaattttttcttgaactggaactgcaactaaagtccgttcggagatccaaaaatctgcaatacagaggttatttgtaacccggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacacgatttatattaggatctgcccatgatgcggatattggtagcaacacactgcagaattaccaactcagtcccagtgatcatttctcactgataaataaagagaaatcagatggcagtaaataccctgagatggtattgaagacacctttggacagagaaaagcagaaatcctaccacttgactttgactgccttggactttggagctccacccctaagcagcactgcacagatacacgttctagtgactgatgccaatgataatgctccagtgttcagtcaagacgtatacagggtgagcctttcagaaaacgtgtacccggggaccacggtgctacaggtgactgccacggaccaggatgagggtgtcaatgccgagattactttctctttcagtgaagctagccagatcacccaatttgacctgaactctaacaccggggaaattactgttttaaatacattagattttgaagaagtcaaagaatattccatagttttggaagcaagggacggtggaggaatgattgcgcaatgcacagtggaggtagaagtcatagatgaaaatgacaacgccccagaagtgatattccagtctctacccaacctaattatggaggacgccgagctgggaacacatattgctttgctcaaagtccgtgacaaggattccagacacaatggagaagtgacttgtaaattggaaggtgatgttccatttaaaatattaacttcttcaagaaacacgtataaattagtgacagatgctgttctagaccgcgagcagaatccagagtacaatataaccgttacggcaacagatcggggcaagcctcccctctcctccagttccagcatcaccctgcacattggtgatgtaaatgacaacgctccggttttctcacagtcttcctatatagtccacgtggccgagaacaacccgcctggagcctctatttcacaagtcagggcttctgatccggacttggggcccaacggccaagtctcttactgcatcatggccagtgacctggagcagcgggagctgtcatcctacgtgtccataagcgcggagagcggggtggtgttcgcgcagcgcgccttcgaccacgagcagctgcgcgccttcgaactcacactgcaggcccgcgaccagggctcgccagcgctcagcgcgaacgtgagcctgcgcgtgttagtggacgaccgcaacgacaatgcgccacgggtgctgtaccccgcgctgggtcccgacggctctgcgctcttcgatatggtgccgcacgctgcagagcctggctacttggtgaccaaggtagtggcggtggacgcagactcaggacacaacgcctggctgtcctaccacgtgctgcaggctagcgagcccgggctcttcagcctggggctgcgcacgggcgaagtgcgcacagcgcgtgccttaggcgacagggacgccgtccgccagcgccttctggtcgccgtgcgtgacggtggacagccaccactctcggccactgccacgttgcacctggtcttcgccgacagcttgcaggaggtgctgccggatatcactgaccgccccgacccctctgacctccaggctgagctgcagttttacctagtggtggccttggccttgatctcagtgctcttcctcgtggccatgattctggccattgccttgcgcctgcgacgctcctccagccccgcctcctggagctgcttccagcctggtctctgtgttaaatccgaatccgtggttccccccaactacagcgaggggactttgccttattcctacaatctatgtgttgcacatacaggaaagacggagtttaatttcctaaaatgtagtgagcagttgagttcaggacaagacatactttgcggtgattcatctggggccttatttccactttgtaattccagtgaattgacttcccatcaggtgagtttcctttaagtataatttaatgctcattgcctacccatttctccatattcacaagaaaatatacatatttgcaggaaaatatataatttttagatgtcatggatcattttaggaaagttgtagtcagttaaaaagctgtcatatcattctacaaaggaggagtaaagtaggagcaattgtgtggcccaacatttgtttgttttttagccaagcttagatttataaagcaatgagggtgtggttttaaccacaaagtgaaagtgttagacagttgttggctctctcctaaaaagtgaatgagatttttcctatacattttccttcttgttgactaatatatgatgaatacttttttcagcttggatataccataaatataaaaataataaagccaaagaatttaagctaaaattcaacacttttcttaactaatttaactggtatggtctccatagtagtccactgttttgtttcctgtgttaacttcccttttgtttcaaaagctcttagaataaggagtcaactggatttttatgtccatggaccccttgtgattatatgcagtgtacgctgtgtgtgcgtgtgtgtgtgtgtgtgtgtgagagagatccttttacttagaaaaaggtctactatgctcattagaagatcaaaagcagattctccttacttgtaacataggagtttcaggattaatctgtattcaagctcattctatatccttcatcaaagaaaagacaatgttttgtgtctgttgtccctctcacacacagccctaatatataatgtgtaactgccttatctgcagccctaaactaatatagctagaggtcttctaatcattctcctacctctaggaaagaaatatagtcttgaaaactgccaatctggtgtgcatacaaaatatatacaaaataccaaggaacattatatgagccttttgctaggtatatctaagcaactgcttcagttaatggccactttacaaattgctgaaagaaggaaacgtctttcgattcttttttttttctttttttttttttgagacagagtctctgtctgttactcaggctgtagtgcagtggcacaatgatagctccctccagcctcaaactcctgggctcaagcattccttctgcatcagcctcctgactagctggaactcaggctcatgccaccagacctggctaatttttctgttttcagtagagaaaatattttctttcactaatttaactggtatggtttccattgtctacccagttttccatatgcataagaaaatatattcacaggaaaatataaagttttcagatttcatgagtggttttaagaaagttttagtcagtgaaaaaactatcataccagtcttcaaaggaagggtgaaataagttcatctgctacgttgcccaggctggtcttgaagggaaacagacttttttgtagtcatacttatcctttggcttcttagtaagtattatatagtcattactttttgcagttttttagatcaaagtgttaatgtaggtaaagttaattttagaatatatgtaaaagtcaagtctgctttaaatttaatcatctctttggtgaaagggatgggatggagctttgctttttatcatatattcatctgtacctttcaagtattcaaatagaaaaatataaacaatgtaaataaaatagcaaaacaatgtaatatctcataaaactgcaatggtaaaagcatttatcctattgaaattccacaatttttatttgaaaatattatcgacatgtaattcaagtggcatttagaagaataatttaaaagcaacaactctatagaaagcttgtaaaatgattaagtagtttaaaccaaataaaacaatttctgagtcagtcatctccagtaggtctattttagtctcaagataaattcatttctggtgacaactgaagttcttagttatttgttagtatatattggagacatttacaataaagcttagagcacaatgggaaatgaaagtatcatgttttttttaagaccaaatgtattgcagaaatgtgagtaatttaatccgatgctacaatctgatcattctgatctaatctgatcatttaataacactaaataaaaccttcatctcacattctttggctgtttcttttaaaatatgggtttacggataaatcaaataaattcaaaacaaagtaataagcaaatgatttttttttctcagtaatctagtagagtattacatttagaagtaatctgtatctcagtgcagtaactatttaggactgtaagcgccgctgttcacctactggaagacaaatgcaaccgaaaacactcagatctcacacctcacgaagacccgcagatgccacaaactaactgctggactgcagcgaaacccgacccctgtttggaggcactccaggtttccggaggattgtcatctccatagctgcggcaagaaactaaataagacccatttatgcacagtgaagattctgagaggattctgcagcaaaacaacaatggccgctccacagagtcgccccagacgcggcgagctgatcctgctgtgcgcgctgctgggaacgctgtgggaaatcgggaggggacagattcgctactctgtgccagaagagacggacaaaggctccttcgtgggtaatatctccaaggacctggggctggacccccggaagctggcgaagcacggagtccgtatcgtctccagaggtaggacgcagctctttgctctgaacccgcgcagcggcagcttgatcaccgcgggcaggatagatcgggaggagctctgcgctcagagcccgcggtgtctgataaatattaacaccctggttgaggataaaggaaaactctttggggtagaaatagaaataattgatattaacgataataacccaaaattccaggtcgaagatctagaagtaaaaattaacgaaatcgcggttcctggagcacgttatccactcccagaagctgttgacccggatgtgggcgtgaactccctccagagctaccagctcagccccaatcaccacttctccctggacgtgcagactggagacaatggagccataaacccagagctggtgctggagcgcgccctggacagggaggaagaggctgctcaccacctggtcctcacggcctcggatggcggcaagccgcctcgctctagcacagtgcgcatccacgtgacagtgttggatacaaatgacaatgccccggtttttcctcacccgatttaccgagtgaaagtccttgagaacatgcccccaggcacgcggctgcttactgtaacagccagcgacccggatgagggaatcaacggaaaagtggcatacaaattccggaaaattaatgaaaaacaaactccgttattccagcttaatgaaaatactggggaaatatcaatagcaaaaagtctagattatgaagaatgttcattttatgaaatggaaatacaagccgaagatgtgggggcacttctggggaggaccaaattgctcatttcggtggaagatgtaaatgacaatagaccagaagtgatcattacgtctttgtttagcccagtgttagaaaattctcttcccgggacagtaattgccttcttgagtgtgcatgaccaagactctggaaagaatggtcaagttgtctgttacacacgtgataatttaccttttaaattagaaaagtcaataggtaattattatagattagtgacaaggaaatatttggaccgagaaaatgtctctatctacaatatcacagtgatggcctcagatctaggaacaccacctctgtccactgaaactcaaatcgctctgcacgtggcagacattaacgacaaccctcctactttccctcatgcctcctactcagcgtatatcctagagaacaacctgagaggagcctccatcttttccttgactgcacacgaccccgacagccaggagaatgcccaggtcacttactctgtgaccgaggacacgctgcagggggcgcccctgtcctcgtatatctccatcaactctgacaccggtgtcctgtatgcgctgcaatctttcgactatgagcagatccgagacctgcagctactggtaacagccagcgacagcggggacccgcccctcagcagcaacatgtcactgagcctgttcgtgctggaccagaatgacaacgcgcccgagatcctgtaccccgccctccccacagacggttccactggcgtggagctggcgccccgctccgcagagcgtggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagatgcgctcaagcagagcctcgtggtggccgtccaggaccatggccagccccctctctccgccactgtcacgctcaccgtagccgtggctgacagcatccccgaagtcctgaccgagttgggcagtctgaagccttcggtcgacccgaacgattcgagccttacactctatctcgtggtggcagtggctgccatctcctgtgtcttcctcgcctttgtcgctgtgcttctggggctcaggctgaggcgctggcacaagtcacgcctgctccaggattccggtggcagattggtaggcgtgcctgcctcacattttgtgggtgttgaggaggtacaggctttcctgcagacctattcccaggaagtctccctcaccgccgactcgcggaagagtcacctgatctttccccagcccaactacgcagacatgctcatcagtcaggagggctgtgagaaaaatgattctttgttaacatccgtagattttcatgaatataagaatgaagctgatcatggtcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgcaaaaaaanaaggggggcgnnnaaagttccnnngggccagttacgctaccgagttcgtgcaaggggccaatagggagcgattaaagcaggcggcggggttacacgtggcgggaaaaggccctgggctgggaggcccctcggggtgctatggacccccaagagttaccgggaaaaaggtagggacccttggggagtggaa

SEQ ID NO: 454952 - DNA, 10018 bp, Homo sapiens
  misc_feature (9723)..(9723): n is a, c, g, or t
cagggcagccccagctcagactccccagcgccagcctttacaccgcttcctcctcggaaaaagaagaattttttcttgaactggaactgcaactaaagtccgttcggagatccaaaaatctgcaatacagaggttatttgtaacccggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacacgatttatattaggatctgcccatgatgcggatattggtagcaacacactgcagaattaccaactcagtcccagtgatcatttctcactgataaataaagagaaatcagatggcagtaaataccctgagatggtattgaagacacctttggacagagaaaagcagaaatcctaccacttgactttgactgccttggactttggagctccacccctaagcagcactgcacagatacacgttctagtgactgatgccaatgataatgctccagtgttcagtcaagacgtatacagggtgagcctttcagaaaacgtgtacccggggaccacggtgctacaggtgactgccacggaccaggatgagggtgtcaatgccgagattactttctctttcagtgaagctagccagatcacccaatttgacctgaactctaacaccggggaaattactgttttaaatacattagattttgaagaagtcaaagaatattccatagttttggaagcaagggacggtggaggaatgattgcgcaatgcacagtggaggtagaagtcatagatgaaaatgacaacgccccagaagtgatattccagtctctacccaacctaattatggaggacgccgagctgggaacacatattgctttgctcaaagtccgtgacaaggattccagacacaatggagaagtgacttgtaaattggaaggtgatgttccatttaaaatattaacttcttcaagaaacacgtataaattagtgacagatgctgttctagaccgcgagcagaatccagagtacaatataaccgttacggcaacagatcggggcaagcctcccctctcctccagttccagcatcaccctgcacattggtgatgtaaatgacaacgctccggttttctcacagtcttcctatatagtccacgtggccgagaacaacccgcctggagcctctatttcacaagtcagggcttctgatccggacttggggcccaacggccaagtctcttactgcatcatggccagtgacctggagcagcgggagctgtcatcctacgtgtccataagcgcggagagcggggtggtgttcgcgcagcgcgccttcgaccacgagcagctgcgcgccttcgaactcacactgcaggcccgcgaccagggctcgccagcgctcagcgcgaacgtgagcctgcgcgtgttagtggacgaccgcaacgacaatgcgccacgggtgctgtaccccgcgctgggtcccgacggctctgcgctcttcgatatggtgccgcacgctgcagagcctggctacttggtgaccaaggtagtggcggtggacgcagactcaggacacaacgcctggctgtcctaccacgtgctgcaggctagcgagcccgggctcttcagcctggggctgcgcacgggcgaagtgcgcacagcgcgtgccttaggcgacagggacgccgtccgccagcgccttctggtcgccgtgcgtgacggtggacagccaccactctcggccactgccacgttgcacctggtcttcgccgacagcttgcaggaggtgctgccggatatcactgaccgccccgacccctctgacctccaggctgagctgcagttttacctagtggtggccttggccttgatctcagtgctcttcctcgtggccatgattctggccattgccttgcgcctgcgacgctcctccagccccgcctcctggagctgcttccagcctggtctctgtgttaaatccgaatccgtggttccccccaactacagcgaggggactttgccttattcctacaatctatgtgttgcacatacaggaaagacggagtttaatttcctaaaatgtagtgagcagttgagttcaggacaagacatactttgcggtgattcatctggggccttatttccactttgtaattccagtgaattgacttcccatcaggtgagtttcctttaagtataatttaatgctcattgcctacccatttctccatattcacaagaaaatatacatatttgcaggaaaatatataatttttagatgtcatggatcattttaggaaagttgtagtcagttaaaaagctgtcatatcattctacaaaggaggagtaaagtaggagcaattgtgtggcccaacatttgtttgttttttagccaagcttagatttataaagcaatgagggtgtggttttaaccacaaagtgaaagtgttagacagttgttggctctctcctaaaaagtgaatgagatttttcctatacattttccttcttgttgactaatatatgatgaatacttttttcagcttggatataccataaatataaaaataataaagccaaagaatttaagctaaaattcaacacttttcttaactaatttaactggtatggtctccatagtagtccactgttttgtttcctgtgttaacttcccttttgtttcaaaagctcttagaataaggagtcaactggatttttatgtccatggaccccttgtgattatatgcagtgtacgctgtgtgtgcgtgtgtgtgtgtgtgtgtgtgagagagatccttttacttagaaaaaggtctactatgctcattagaagatcaaaagcagattctccttacttgtaacataggagtttcaggattaatctgtattcaagctcattctatatccttcatcaaagaaaagacaatgttttgtgtctgttgtccctctcacacacagccctaatatataatgtgtaactgccttatctgcagccctaaactaatatagctagaggtcttctaatcattctcctacctctaggaaagaaatatagtcttgaaaactgccaatctggtgtgcatacaaaatatatacaaaataccaaggaacattatatgagccttttgctaggtatatctaagcaactgcttcagttaatggccactttacaaattgctgaaagaaggaaacgtctttcgattcttttttttttctttttttttttttgagacagagtctctgtctgttactcaggctgtagtgcagtggcacaatgatagctccctccagcctcaaactcctgggctcaagcattccttctgcatcagcctcctgactagctggaactcaggctcatgccaccagacctggctaatttttctgttttcagtagagaaaatattttctttcactaatttaactggtatggtttccattgtctacccagttttccatatgcataagaaaatatattcacaggaaaatataaagttttcagatttcatgagtggttttaagaaagttttagtcagtgaaaaaactatcataccagtcttcaaaggaagggtgaaataagttcatctgctacgttgcccaggctggtcttgaagggaaacagacttttttgtagtcatacttatcctttggcttcttagtaagtattatatagtcattactttttgcagttttttagatcaaagtgttaatgtaggtaaagttaattttagaatatatgtaaaagtcaagtctgctttaaatttaatcatctctttggtgaaagggatgggatggagctttgctttttatcatatattcatctgtacctttcaagtattcaaatagaaaaatataaacaatgtaaataaaatagcaaaacaatgtaatatctcataaaactgcaatggtaaaagcatttatcctattgaaattccacaatttttatttgaaaatattatcgacatgtaattcaagtggcatttagaagaataatttaaaagcaacaactctatagaaagcttgtaaaatgattaagtagtttaaaccaaataaaacaatttctgagtcagtcatctccagtaggtctattttagtctcaagataaattcatttctggtgacaactgaagttcttagttatttgttagtatatattggagacatttacaataaagcttagagcacaatgggaaatgaaagtatcatgttttttttaagaccaaatgtattgcagaaatgtgagtaatttaatccgatgctacaatctgatcattctgatctaatctgatcatttaataacactaaataaaaccttcatctcacattctttggctgtttcttttaaaatatgggtttacggataaatcaaataaattcaaaacaaagtaataagcaaatgatttttttttctcagtaatctagtagagtattacatttagaagtaatctgtatctcagtgcagtaactatttaggactgtaagcgccgctgttcacctactggaagacaaatgcaaccgaaaacactcagatctcacacctcacgaagacccgcagatgccacaaactaactgctggactgcagcgaaacccgacccctgtttggaggcactccaggtttccggaggattgtcatctccatagctgcggcaagaaactaaataagacccatttatgcacagtgaagattctgagaggattctgcagcaaaacaacaatggccgctccacagagtcgccccagacgcggcgagctgatcctgctgtgcgcgctgctgggaacgctgtgggaaatcgggaggggacagattcgctactctgtgccagaagagacggacaaaggctccttcgtgggtaatatctccaaggacctggggctggacccccggaagctggcgaagcacggagtccgtatcgtctccagaggtaggacgcagctctttgctctgaacccgcgcagcggcagcttgatcaccgcgggcaggatagatcgggaggagctctgcgctcagagcccgcggtgtctgataaatattaacaccctggttgaggataaaggaaaactctttggggtagaaatagaaataattgatattaacgataataacccaaaattccaggtcgaagatctagaagtaaaaattaacgaaatcgcggttcctggagcacgttatccactcccagaagctgttgacccggatgtgggcgtgaactccctccagagctaccagctcagccccaatcaccacttctccctggacgtgcagactggagacaatggagccataaacccagagctggtgctggagcgcgccctggacagggaggaagaggctgctcaccacctggtcctcacggcctcggatggcggcaagccgcctcgctctagcacagtgcgcatccacgtgacagtgttggatacaaatgacaatgccccggtttttcctcacccgatttaccgagtgaaagtccttgagaacatgcccccaggcacgcggctgcttactgtaacagccagcgacccggatgagggaatcaacggaaaagtggcatacaaattccggaaaattaatgaaaaacaaactccgttattccagcttaatgaaaatactggggaaatatcaatagcaaaaagtctagattatgaagaatgttcattttatgaaatggaaatacaagccgaagatgtgggggcacttctggggaggaccaaattgctcatttcggtggaagatgtaaatgacaatagaccagaagtgatcattacgtctttgtttagcccagtgttagaaaattctcttcccgggacagtaattgccttcttgagtgtgcatgaccaagactctggaaagaatggtcaagttgtctgttacacacgtgataatttaccttttaaattagaaaagtcaataggtaattattatagattagtgacaaggaaatatttggaccgagaaaatgtctctatctacaatatcacagtgatggcctcagatctaggaacaccacctctgtccactgaaactcaaatcgctctgcacgtggcagacattaacgacaaccctcctactttccctcatgcctcctactcagcgtatatcctagagaacaacctgagaggagcctccatcttttccttgactgcacacgaccccgacagccaggagaatgcccaggtcacttactctgtgaccgaggacacgctgcagggggcgcccctgtcctcgtatatctccatcaactctgacaccggtgtcctgtatgcgctgcaatctttcgactatgagcagatccgagacctgcagctactggtaacagccagcgacagcggggacccgcccctcagcagcaacatgtcactgagcctgttcgtgctggaccagaatgacaacgcgcccgagatcctgtaccccgccctccccacagacggttccactggcgtggagctggcgccccgctccgcagagcgtggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagatgcgctcaagcagagcctcgtggtggccgtccaggaccatggccagccccctctctccgccactgtcacgctcaccgtagccgtggctgacagcatccccgaagtcctgaccgagttgggcagtctgaagccttcggtcgacccgaacgattcgagccttacactctatctcgtggtggcagtggctgccatctcctgtgtcttcctcgcctttgtcgctgtgcttctggggctcaggctgaggcgctggcacaagtcacgcctgctccaggattccggtggcagattggtaggcgtgcctgcctcacattttgtgggtgttgaggaggtacaggctttcctgcagacctattcccaggaagtctccctcaccgccgactcgcggaagagtcacctgatctttccccagcccaactacgcagacatgctcatcagtcaggagggctgtgagaaaaatgattctttgttaacatccgtagattttcatgaatataagaatgaagctgatcatggtcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaaacaancaacagacaaaccacaacgaacagcaacaataaatacaccaaaaaaaaacagaacaagcacagacacacaccaccaacacacaaacagaggggaaccccacaaaaaaaacacacaaaaaagcacacacaataaaggaccccccaccaatgttcatcgaaaaagggacgcaccaagaaggaacctaataaaaacaggcacgactgcacagtcaaaaaaagacgaggcaggaaaaaagcaacagggccaccgctcgaagacaccacaagtgaggggcaacaaggaggccaacaacca

SEQ ID NO: 454953 - DNA, 10184 bp, Homo sapiens
cagggcagccccagctcagactccccagcgccagcctttacaccgcttcctcctcggaaaaagaagaattttttcttgaactggaactgcaactaaagtccgttcggagatccaaaaatctgcaatacagaggttatttgtaacccggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacacgatttatattaggatctgcccatgatgcggatattggtagcaacacactgcagaattaccaactcagtcccagtgatcatttctcactgataaataaagagaaatcagatggcagtaaataccctgagatggtattgaagacacctttggacagagaaaagcagaaatcctaccacttgactttgactgccttggactttggagctccacccctaagcagcactgcacagatacacgttctagtgactgatgccaatgataatgctccagtgttcagtcaagacgtatacagggtgagcctttcagaaaacgtgtacccggggaccacggtgctacaggtgactgccacggaccaggatgagggtgtcaatgccgagattactttctctttcagtgaagctagccagatcacccaatttgacctgaactctaacaccggggaaattactgttttaaatacattagattttgaagaagtcaaagaatattccatagttttggaagcaagggacggtggaggaatgattgcgcaatgcacagtggaggtagaagtcatagatgaaaatgacaacgccccagaagtgatattccagtctctacccaacctaattatggaggacgccgagctgggaacacatattgctttgctcaaagtccgtgacaaggattccagacacaatggagaagtgacttgtaaattggaaggtgatgttccatttaaaatattaacttcttcaagaaacacgtataaattagtgacagatgctgttctagaccgcgagcagaatccagagtacaatataaccgttacggcaacagatcggggcaagcctcccctctcctccagttccagcatcaccctgcacattggtgatgtaaatgacaacgctccggttttctcacagtcttcctatatagtccacgtggccgagaacaacccgcctggagcctctatttcacaagtcagggcttctgatccggacttggggcccaacggccaagtctcttactgcatcatggccagtgacctggagcagcgggagctgtcatcctacgtgtccataagcgcggagagcggggtggtgttcgcgcagcgcgccttcgaccacgagcagctgcgcgccttcgaactcacactgcaggcccgcgaccagggctcgccagcgctcagcgcgaacgtgagcctgcgcgtgttagtggacgaccgcaacgacaatgcgccacgggtgctgtaccccgcgctgggtcccgacggctctgcgctcttcgatatggtgccgcacgctgcagagcctggctacttggtgaccaaggtagtggcggtggacgcagactcaggacacaacgcctggctgtcctaccacgtgctgcaggctagcgagcccgggctcttcagcctggggctgcgcacgggcgaagtgcgcacagcgcgtgccttaggcgacagggacgccgtccgccagcgccttctggtcgccgtgcgtgacggtggacagccaccactctcggccactgccacgttgcacctggtcttcgccgacagcttgcaggaggtgctgccggatatcactgaccgccccgacccctctgacctccaggctgagctgcagttttacctagtggtggccttggccttgatctcagtgctcttcctcgtggccatgattctggccattgccttgcgcctgcgacgctcctccagccccgcctcctggagctgcttccagcctggtctctgtgttaaatccgaatccgtggttccccccaactacagcgaggggactttgccttattcctacaatctatgtgttgcacatacaggaaagacggagtttaatttcctaaaatgtagtgagcagttgagttcaggacaagacatactttgcggtgattcatctggggccttatttccactttgtaattccagtgaattgacttcccatcaggtgagtttcctttaagtataatttaatgctcattgcctacccatttctccatattcacaagaaaatatacatatttgcaggaaaatatataatttttagatgtcatggatcattttaggaaagttgtagtcagttaaaaagctgtcatatcattctacaaaggaggagtaaagtaggagcaattgtgtggcccaacatttgtttgttttttagccaagcttagatttataaagcaatgagggtgtggttttaaccacaaagtgaaagtgttagacagttgttggctctctcctaaaaagtgaatgagatttttcctatacattttccttcttgttgactaatatatgatgaatacttttttcagcttggatataccataaatataaaaataataaagccaaagaatttaagctaaaattcaacacttttcttaactaatttaactggtatggtctccatagtagtccactgttttgtttcctgtgttaacttcccttttgtttcaaaagctcttagaataaggagtcaactggatttttatgtccatggaccccttgtgattatatgcagtgtacgctgtgtgtgcgtgtgtgtgtgtgtgtgtgtgagagagatccttttacttagaaaaaggtctactatgctcattagaagatcaaaagcagattctccttacttgtaacataggagtttcaggattaatctgtattcaagctcattctatatccttcatcaaagaaaagacaatgttttgtgtctgttgtccctctcacacacagccctaatatataatgtgtaactgccttatctgcagccctaaactaatatagctagaggtcttctaatcattctcctacctctaggaaagaaatatagtcttgaaaactgccaatctggtgtgcatacaaaatatatacaaaataccaaggaacattatatgagccttttgctaggtatatctaagcaactgcttcagttaatggccactttacaaattgctgaaagaaggaaacgtctttcgattcttttttttttctttttttttttttgagacagagtctctgtctgttactcaggctgtagtgcagtggcacaatgatagctccctccagcctcaaactcctgggctcaagcattccttctgcatcagcctcctgactagctggaactcaggctcatgccaccagacctggctaatttttctgttttcagtagagaaaatattttctttcactaatttaactggtatggtttccattgtctacccagttttccatatgcataagaaaatatattcacaggaaaatataaagttttcagatttcatgagtggttttaagaaagttttagtcagtgaaaaaactatcataccagtcttcaaaggaagggtgaaataagttcatctgctacgttgcccaggctggtcttgaagggaaacagacttttttgtagtcatacttatcctttggcttcttagtaagtattatatagtcattactttttgcagttttttagatcaaagtgttaatgtaggtaaagttaattttagaatatatgtaaaagtcaagtctgctttaaatttaatcatctctttggtgaaagggatgggatggagctttgctttttatcatatattcatctgtacctttcaagtattcaaatagaaaaatataaacaatgtaaataaaatagcaaaacaatgtaatatctcataaaactgcaatggtaaaagcatttatcctattgaaattccacaatttttatttgaaaatattatcgacatgtaattcaagtggcatttagaagaataatttaaaagcaacaactctatagaaagcttgtaaaatgattaagtagtttaaaccaaataaaacaatttctgagtcagtcatctccagtaggtctattttagtctcaagataaattcatttctggtgacaactgaagttcttagttatttgttagtatatattggagacatttacaataaagcttagagcacaatgggaaatgaaagtatcatgttttttttaagaccaaatgtattgcagaaatgtgagtaatttaatccgatgctacaatctgatcattctgatctaatctgatcatttaataacactaaataaaaccttcatctcacattctttggctgtttcttttaaaatatgggtttacggataaatcaaataaattcaaaacaaagtaataagcaaatgatttttttttctcagtaatctagtagagtattacatttagaagtaatctgtatctcagtgcagtaactatttaggactgtaagcgccgctgttcacctactggaagacaaatgcaaccgaaaacactcagatctcacacctcacgaagacccgcagatgccacaaactaactgctggactgcagcgaaacccgacccctgtttggaggcactccaggtttccggaggattgtcatctccatagctgcggcaagaaactaaataagacccatttatgcacagtgaagattctgagaggattctgcagcaaaacaacaatggccgctccacagagtcgccccagacgcggcgagctgatcctgctgtgcgcgctgctgggaacgctgtgggaaatcgggaggggacagattcgctactctgtgccagaagagacggacaaaggctccttcgtgggtaatatctccaaggacctggggctggacccccggaagctggcgaagcacggagtccgtatcgtctccagaggtaggacgcagctctttgctctgaacccgcgcagcggcagcttgatcaccgcgggcaggatagatcgggaggagctctgcgctcagagcccgcggtgtctgataaatattaacaccctggttgaggataaaggaaaactctttggggtagaaatagaaataattgatattaacgataataacccaaaattccaggtcgaagatctagaagtaaaaattaacgaaatcgcggttcctggagcacgttatccactcccagaagctgttgacccggatgtgggcgtgaactccctccagagctaccagctcagccccaatcaccacttctccctggacgtgcagactggagacaatggagccataaacccagagctggtgctggagcgcgccctggacagggaggaagaggctgctcaccacctggtcctcacggcctcggatggcggcaagccgcctcgctctagcacagtgcgcatccacgtgacagtgttggatacaaatgacaatgccccggtttttcctcacccgatttaccgagtgaaagtccttgagaacatgcccccaggcacgcggctgcttactgtaacagccagcgacccggatgagggaatcaacggaaaagtggcatacaaattccggaaaattaatgaaaaacaaactccgttattccagcttaatgaaaatactggggaaatatcaatagcaaaaagtctagattatgaagaatgttcattttatgaaatggaaatacaagccgaagatgtgggggcacttctggggaggaccaaattgctcatttcggtggaagatgtaaatgacaatagaccagaagtgatcattacgtctttgtttagcccagtgttagaaaattctcttcccgggacagtaattgccttcttgagtgtgcatgaccaagactctggaaagaatggtcaagttgtctgttacacacgtgataatttaccttttaaattagaaaagtcaataggtaattattatagattagtgacaaggaaatatttggaccgagaaaatgtctctatctacaatatcacagtgatggcctcagatctaggaacaccacctctgtccactgaaactcaaatcgctctgcacgtggcagacattaacgacaaccctcctactttccctcatgcctcctactcagcgtatatcctagagaacaacctgagaggagcctccatcttttccttgactgcacacgaccccgacagccaggagaatgcccaggtcacttactctgtgaccgaggacacgctgcagggggcgcccctgtcctcgtatatctccatcaactctgacaccggtgtcctgtatgcgctgcaatctttcgactatgagcagatccgagacctgcagctactggtaacagccagcgacagcggggacccgcccctcagcagcaacatgtcactgagcctgttcgtgctggaccagaatgacaacgcgcccgagatcctgtaccccgccctccccacagacggttccactggcgtggagctggcgccccgctccgcagagcgtggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagatgcgctcaagcagagcctcgtggtggccgtccaggaccatggccagccccctctctccgccactgtcacgctcaccgtagccgtggctgacagcatccccgaagtcctgaccgagttgggcagtctgaagccttcggtcgacccgaacgattcgagccttacactctatctcgtggtggcagtggctgccatctcctgtgtcttcctcgcctttgtcgctgtgcttctggggctcaggctgaggcgctggcacaagtcacgcctgctccaggattccggtggcagattggtaggcgtgcctgcctcacattttgtgggtgttgaggaggtacaggctttcctgcagacctattcccaggaagtctccctcaccgccgactcgcggaagagtcacctgatctttccccagcccaactacgcagacatgctcatcagtcaggagggctgtgagaaaaatgattctttgttaacatccgtagattttcatgaatataagaatgaagctgatcatggtcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgagggggggcggttgtaaagaagttctctcccgtgcggggggccacgatgttaacggagtaccccaggttctatcttcgtcactaacggtgggccctcatagtgatgagagatttcgatattaattagcgcaatgggcatcgtggcctcgcctgtttacaccaagcctgttctgcgtgctgggaaaacaactgcggctaacttgggggaatcctcttggtgaaaggagacccctatacttgtccgggtgggtgtggacagttattttgggcacaatgctacctttacagaagcattttaaagggttcatacgggatagagttaatagaagtttttgaacgcgtgcttctagggggtgttgaacagttatgacggcaatattgtttgggaaggcttgtgaaaaagtttaggcgaaaacgggagatactgatttcgtggagacttgtttatagcagcggtgtcttgtggaaaa

SEQ ID NO: 454954 - DNA, 8305 bp, Homo sapiens
cagggcagccccagctcagactccccagcgccagcctttacaccgcttcctcctcggaaaaagaagaattttttcttgaactggaactgcaactaaagtccgttcggagatccaaaaatctgcaatacagaggttatttgtaacccggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacacgatttatattaggatctgcccatgatgcggatattggtagcaacacactgcagaattaccaactcagtcccagtgatcatttctcactgataaataaagagaaatcagatggcagtaaataccctgagatggtattgaagacacctttggacagagaaaagcagaaatcctaccacttgactttgactgccttggactttggagctccacccctaagcagcactgcacagatacacgttctagtgactgatgccaatgataatgctccagtgttcagtcaagacgtatacagggtgagcctttcagaaaacgtgtacccggggaccacggtgctacaggtgactgccacggaccaggatgagggtgtcaatgccgagattactttctctttcagtgaagctagccagatcacccaatttgacctgaactctaacaccggggaaattactgttttaaatacattagattttgaagaagtcaaagaatattccatagttttggaagcaagggacggtggaggaatgattgcgcaatgcacagtggaggtagaagtcatagatgaaaatgacaacgccccagaagtgatattccagtctctacccaacctaattatggaggacgccgagctgggaacacatattgctttgctcaaagtccgtgacaaggattccagacacaatggagaagtgacttgtaaattggaaggtgatgttccatttaaaatattaacttcttcaagaaacacgtataaattagtgacagatgctgttctagaccgcgagcagaatccagagtacaatataaccgttacggcaacagatcggggcaagcctcccctctcctccagttccagcatcaccctgcacattggtgatgtaaatgacaacgctccggttttctcacagtcttcctatatagtccacgtggccgagaacaacccgcctggagcctctatttcacaagtcagggcttctgatccggacttggggcccaacggccaagtctcttactgcatcatggccagtgacctggagcagcgggagctgtcatcctacgtgtccataagcgcggagagcggggtggtgttcgcgcagcgcgccttcgaccacgagcagctgcgcgccttcgaactcacactgcaggcccgcgaccagggctcgccagcgctcagcgcgaacgtgagcctgcgcgtgttagtggacgaccgcaacgacaatgcgccacgggtgctgtaccccgcgctgggtcccgacggctctgcgctcttcgatatggtgccgcacgctgcagagcctggctacttggtgaccaaggtagtggcggtggacgcagactcaggacacaacgcctggctgtcctaccacgtgctgcaggctagcgagcccgggctcttcagcctggggctgcgcacgggcgaagtgcgcacagcgcgtgccttaggcgacagggacgccgtccgccagcgccttctggtcgccgtgcgtgacggtggacagccaccactctcggccactgccacgttgcacctggtcttcgccgacagcttgcaggaggtgctgccggatatcactgaccgccccgacccctctgacctccaggctgagctgcagttttacctagtggtggccttggccttgatctcagtgctcttcctcgtggccatgattctggccattgccttgcgcctgcgacgctcctccagccccgcctcctggagctgcttccagcctggtctctgtgttaaatccgaatccgtggttccccccaactacagcgaggggactttgccttattcctacaatctatgtgttgcacatacaggaaagacggagtttaatttcctaaaatgtagtgagcagttgagttcaggacaagacatactttgcggtgattcatctggggccttatttccactttgtaattccagtgaattgacttcccatcaggtgagtttcctttaagtataatttaatgctcattgcctacccatttctccatattcacaagaaaatatacatatttgcaggaaaatatataatttttagatgtcatggatcattttaggaaagttgtagtcagttaaaaagctgtcatatcattctacaaaggaggagtaaagtaggagcaattgtgtggcccaacatttgtttgttttttagccaagcttagatttataaagcaatgagggtgtggttttaaccacaaagtgaaagtgttagacagttgttggctctctcctaaaaagtgaatgagatttttcctatacattttccttcttgttgactaatatatgatgaatacttttttcagcttggatataccataaatataaaaataataaagccaaagaatttaagctaaaattcaacacttttcttaactaatttaactggtatggtctccatagtagtccactgttttgtttcctgtgttaacttcccttttgtttcaaaagctcttagaataaggagtcaactggatttttatgtccatggaccccttgtgattatatgcagtgtacgctgtgtgtgcgtgtgtgtgtgtgtgtgtgtgagagagatccttttacttagaaaaaggtctactatgctcattagaagatcaaaagcagattctccttacttgtaacataggagtttcaggattaatctgtattcaagctcattctatatccttcatcaaagaaaagacaatgttttgtgtctgttgtccctctcacacacagccctaatatataatgtgtaactgccttatctgcagccctaaactaatatagctagaggtcttctaatcattctcctacctctaggaaagaaatatagtcttgaaaactgccaatctggtgtgcatacaaaatatatacaaaataccaaggaacattatatgagccttttgctaggtatatctaagcaactgcttcagttaatggccactttacaaattgctgaaagaaggaaacgtctttcgattcttttttttttctttttttttttttgagacagagtctctgtctgttactcaggctgtagtgcagtggcacaatgatagctccctccagcctcaaactcctgggctcaagcattccttctgcatcagcctcctgactagctggaactcaggctcatgccaccagacctggctaatttttctgttttcagtagagaaaatattttctttcactaatttaactggtatggtttccattgtctacccagttttccatatgcataagaaaatatattcacaggaaaatataaagttttcagatttcatgagtggttttaagaaagttttagtcagtgaaaaaactatcataccagtcttcaaaggaagggtgaaataagttcatctgctacgttgcccaggctggtcttgaagggaaacagacttttttgtagtcatacttatcctttggcttcttagtaagtattatatagtcattactttttgcagttttttagatcaaagtgttaatgtaggtaaagttaattttagaatatatgtaaaagtcaagtctgctttaaatttaatcatctctttggtgaaagggatgggatggagctttgctttttatcatatattcatctgtacctttcaagtattcaaatagaaaaatataaacaatgtaaataaaatagcaaaacaatgtaatatctcataaaactgcaatggtaaaagcatttatcctattgaaattccacaatttttatttgaaaatattatcgacatgtaattcaagtggcatttagaagaataatttaaaagcaacaactctatagaaagcttgtaaaatgattaagtagtttaaaccaaataaaacaatttctgagtcagtcatctccagtaggtctattttagtctcaagataaattcatttctggtgacaactgaagttcttagttatttgttagtatatattggagacatttacaataaagcttagagcacaatgggaaatgaaagtatcatgttttttttaagaccaaatgtattgcagaaatgtgagtaatttaatccgatgctacaatctgatcattctgatctaatctgatcatttaataacactaaataaaaccttcatctcacattctttggctgtttcttttaaaatatgggtttacggataaatcaaataaattcaaaacaaagtaataagcaaatgatttttttttctcagtaatctagtagagtattacatttagaagtaatctgtatctcagtgcagtaactatttaggactgtaagcgccgctgttcacctactggaagacaaatgcaaccgaaaacactcagatctcacacctcacgaagacccgcagatgccacaaactaactgctggactgcagcgaaacccgacccctgtttggaggcactccaggtttccggaggattgtcatctccatagctgcggcaagaaactaaataagacccatttatgcacagtgaagattctgagaggattctgcagcaaaacaacaatggccgctccacagagtcgccccagacgcggcgagctgatcctgctgtgcgcgctgctgggaacgctgtgggaaatcgggaggggacagattcgctactctgtgccagaagagacggacaaaggctccttcgtgggtaatatctccaaggacctggggctggacccccggaagctggcgaagcacggagtccgtatcgtctccagaggtaggacgcagctctttgctctgaacccgcgcagcggcagcttgatcaccgcgggcaggatagatcgggaggagctctgcgctcagagcccgcggtgtctgataaatattaacaccctggttgaggataaaggaaaactctttggggtagaaatagaaataattgatattaacgataataacccaaaattccaggtcgaagatctagaagtaaaaattaacgaaatcgcggttcctggagcacgttatccactcccagaagctgttgacccggatgtgggcgtgaactccctccagagctaccagctcagccccaatcaccacttctccctggacgtgcagactggagacaatggagccataaacccagagctggtgctggagcgcgccctggacagggaggaagaggctgctcaccacctggtcctcacggcctcggatggcggcaagccgcctcgctctagcacagtgcgcatccacgtgacagtgttggatacaaatgacaatgccccggtttttcctcacccgatttaccgagtgaaagtccttgagaacatgcccccaggcacgcggctgcttactgtaacagccagcgacccggatgagggaatcaacggaaaagtggcatacaaattccggaaaattaatgaaaaacaaactccgttattccagcttaatgaaaatactggggaaatatcaatagcaaaaagtctagattatgaagaatgttcattttatgaaatggaaatacaagccgaagatgtgggggcacttctggggaggaccaaattgctcatttcggtggaagatgtaaatgacaatagaccagaagtgatcattacgtctttgtttagcccagtgttagaaaattctcttcccgggacagtaattgccttcttgagtgtgcatgaccaagactctggaaagaatggtcaagttgtctgttacacacgtgataatttaccttttaaattagaaaagtcaataggtaattattatagattagtgacaaggaaatatttggaccgagaaaatgtctctatctacaatatcacagtgatggcctcagatctaggaacaccacctctgtccactgaaactcaaatcgctctgcacgtggcagacattaacgacaaccctcctactttccctcatgcctcctactcagcgtatatcctagagaacaacctgagaggagcctccatcttttccttgactgcacacgaccccgacagccaggagaatgcccaggtcacttactctgtgaccgaggacacgctgcagggggcgcccctgtcctcgtatatctccatcaactctgacaccggtgtcctgtatgcgctgcaatctttcgactatgagcagatccgagacctgcagctactggtaacagccagcgacagcggggacccgcccctcagcagcaacatgtcactgagcctgttcgtgctggaccagaatgacaacgcgcccgagatcctgtaccccgccctccccacagacggttccactggcgtggagctggcgccccgctccgcagagcgtggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagatgcgctcaagcagagcctcgtggtggccgtccaggaccatggccagccccctctctccgccactgtcacgctcaccgtagccgtggctgacagcatccccgaagtcctgaccgagttgggcagtctgaagccttcggtcgacccgaacgattcgagccttacactctatctcgtggtggcagtggctgccatctcctgtgtcttcctcgcctttgtcgctgtgcttctggggctcaggctgaggcgctggcacaagtcacgcctgctccaggattccggtggcagattggtaggcgtgcctgcctcacattttgtgggtgttgaggaggtacaggctttcctgcagacctattcccaggaagtctccctcaccgccgactcgcggaagagtcacctgatctttccccagcccaactacgcagacatgctcatcagtcaggagggctgtgagaaaaatgattctttgttaacatccgtagattttcatgaatataagaatgaagctgatcatggtcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcattccatcatacaagccccattaccgcggggattctttaaaatcggactgcaggcaat

SEQ ID NO: 454955 - DNA, 2755 bp, Homo sapiens
gcggggaaagggagataggtgtctccagctgctgtggctgtttggggcgggtcggcttcatccgcgtctcaggagcaagtagagaattagcgggcggcagcaatgctccgcaaggtgagaagctggacagaaatctggcggtgggctacccttttgttcctcttttaccacctgggttacgtttgtgggcagatccgctacccggtcccagaggagtcacaggaagggacttttgtagggaatgtcgctcaagatttcctgctggatacggacagtctgtcagctcgcaggctgcaggtcgctggagaggtgaaccaaagacacttccgtgtggatttggacagcggagccctgctcatcaagaacccaatcgaccgagaggcactgtgtgggctcagtgccagctgcatcgtgcccctggagtttgtcaccgaaggtcctttggaaatgtaccgagcagaggtagagatcgtagatgtgaatgatcacgccccccgttttccgcggcagcagctggacttggaaattggggaggcagctcctccaggacagcgtttcccgttggaaaaggctcaggatgcagatgtggggagcaattcgattagcagctataggctgagctccaatgaacactttgcactggatgtgaagaagcgcagcgacggcagcctggtcccagagctgctcctggagaagcctttggatcgagagaagcaatcggactaccgcctggtgctgactgctgtcgatggagggaacccgccgagatctggcaccgcagagctccgggtatccgtgctggacgtaaacgacaacgccccagccttccagcaatccagctacaggattagtgtgttggagagcgcaccagcgggcatggtgctcatccagctcaatgcctcagacccggacctgggtcccagtggtaacgtcaccttttatttcagtggtcatacccctgatcgtgtaagaaacctctttagcctgcaccccactactggaaagcttactcttttggggcccctagactttgagagtgagaattactatgaatttgatgtgcgggctcgcgatgggggttctccagccatggagcaacattgcagccttcgagtggatctgctggacgtaaatgacaatgccccttacatcacagtgacctcagagcttggaaccctccccgagagtgcagaacctggcactgtggtggcacttatcagtgtgcaggatccagactcagggtcaaacggagatgtgagcctccgcattcctgaccacttgccatttgccctcaagtctgccttcaggaaccagttctccctggtgactgctggacccttggatcgagaggccaaatctagctatgacatcatggtcactgcttctgatgctgggaaccctcctctcagtacccacagaactattttcctcaatatttcagatgtgaatgataatccaccctctttctttcagaggtcacatgaggtgtttgttcctgagaacaatcgcccaggggacctgctttgctcccttgcagcctctgacccagactctggcttgaatgcgcttatctcctactcactcctggagcccaggaatcgagatgtatcagcttcctctttcatctctctgaacccccagacaggagctgttcatgctactcgatcctttgactatgagcaaacccagacactgcagtttgaggtgcaggcccgggatcggggcaacccaccccttagcagcactgtaacagttcgtctatttgtgctggacctcaatgacaatgctccagctgtgctccgtcctcgggcccggcctggttccttatgtccccaagcactgcctccatcagttggtgctggccacctaatcacaaaggtgactgctgtggacttggattcaggttacaatgcttgggtttcctatcagctcctggaggccccagatcccagcctgtttgcagtctctcgatatgctggggaggtgcggacggctgttcctatcccagctgacctcccaccacagaagctggtcattgtggtaaaggatagtggtagtccaccactctctacctctgttactctcttagtgtccttagaggaagacactcatccagttgtcccagatcttcgagaatcttcagctccaagggaaggagaatctcgtctaaccctctacttggctgtgtccctagtggcaatttgctttgtctcctttggctcattcgtggcactactctctaagtgtcttcgtggggcagcctgtggagtcacatgctttcctgctggcacctgtgcctgtctcaccagatctcgaaggagggaggggcttcccccttccaatgggatcctccgaatccagctagggtcagatgaccctatcaagtttgttgatgtgggaggccactctcatggctgtacacccttggcttctgcacccactcggagtgatagcttcatgatggtgaagtcacccagtgcacctatggcaggggagcctgttcgcccaagctgcccaccctctgatcttctctatgggctagaggtgagacctttgcaggctcaacaaatgcttgagggttattctgatccaggcatatggctaggccatgtcctagagagtactggcctctcagtaagtgcccatagtgatgtcaccatttttgtaagaggtaactatgtggtagacgctgtgctttgtaactgtttcgtgaattaaccagagttgtcacagtttagcattgggggcgggtcat

SEQ ID NO: 454956 - DNA, 2888 bp, Homo sapiens
attggctgggactctgtgtgccgctgtcggccaatgaagacgctggagatcgggcccctgcccgtcccctttctgcgccccgggatgaggcagagactgaacagccggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattgcaaagtgttggtggaggttgtggatgtgaatgacaacgccccggagatcacagtcacctccgtgtacagcccagtacccgaggatgcccctctggggactgtcatcgctttgctcagtgtgactgacctggatgctggcgagaacgggctggtgacctgcgaagttccaccgggtctccctttcagccttacttcttccctcaagaattacttcactttgaaaaccagtgcagacctggatcgggagactgtgccagaatacaacctcagcatcaccgcccgagacgccggaaccccttccctctcagcccttacaatagtgcgtgttcaagtgtccgacatcaatgacaaccctccacaatcttctcaatcttcctacgacgtttacattgaagaaaacaacctccccggggctccaatactaaacctaagtgtctgggaccccgacgccccgcagaatgctcggctttctttctttctcttggagcaaggagctgaaaccgggctagtgggtcgctatttcacaataaatcgtgacaatggcatagtgtcatccttagtgcccctagactatgaggatcggcgggaatttgaattaacagctcatatcagcgatgggggcaccccggtcctagccaccaacatcagcgtgaacatatttgtcactgatcgcaatgacaatgccccccaggtcctatatcctcggccaggtgggagctcggtggagatgctgcctcgaggtacctcagctggccacctagtgtcacgggtggtaggctgggacgcggatgcagggcacaatgcctggctctcctacagtctcttgggatcccctaaccagagcctttttgccatagggctgcacactggtcaaatcagtactgcccgtccagtccaagacacagattcacccaggcagactctcacggtcttgatcaaagacaatggggagccttcgctctccaccactgctaccctcactgtgtcagtaaccgaggactctcctgaagcccgagccgagttcccctctggctctgccccccggagttaaaccttctttaattatggattagccattaacatttttgaaacgtggaccatttaacctcggcctaccccctccaactgtcctggtgatgagttcattagctaagttaaattaattgaactttgatctaaaccaaaacaaatcaggaaaataaagctgtaaaggaacttatcaagcattccaaaaccaactagaaattacttgaagtttcgagtgagcattgcctgtgccagtattcttcattataggattataaactcgtttttttcccaaagcgcatgtctacgccaggcagaggagtaattattcagccaatttcatggatgtaacgatggatataaataattgatagcacctagaggcttccagtttgggtggaaggctaaaagtagaggggaactcactcacttgagaaatgatatttaagtgaataaatagttctcttctatgaaactattactatttagttctctggaaaacttaagtgtattaatgattagaacatcaaatcctaagtaaagaaatgacattttaaatataaaaagccaaactttaaataaatcatagagacctcagacataatataggaaa

SEQ ID NO: 454957 - DNA, 999 bp, Homo sapiens
catcttccaaatcaatcaggcccatccatcccatgcctccttcgctctccaccactgctaccctcactgtgtcagtaaccgaggactctcctgaagcccgagccgagttcccctctggctctgccccccgggagcagaaaaaaaatctcaccttttatctacttctttctctaatcctggtttctgtggggtttgtggtcacagtgttcggagtaatcatattcaaagtttacaagtggaagcagtctagagacctataccgagccccggtgagctcactgtaccgaacaccagggccctccttgcacgcggacgccgtgcggggaggcctgatgtcgccgcacctttaccatcaggtgtatctcaccacggactcccgccgcagcgacccgctgctgaagaaacctggtgcagccagtccactggccagccgccagaacacgctgcggagctgtgatccggtgttctataggcaggtgttgggtgcagagagcgcccctcccggacagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctaaacgtttctgtataag

SEQ ID NO: 454958 - DNA, 319 bp, Homo sapiens
ctctctctctctctctctctctctgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctaaacgtttctgtataag

SEQ ID NO: 454959 - DNA, 4845 bp, Homo sapiens
attggctgggactctgtgtgccgctgtcggccaatgaagacgctggagatcgggcccctgcccgtcccctttctgcgccccgggatgaggcagagactgaacagccggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattgcaaagtgttggtggaggttgtggatgtgaatgacaacgccccggagatcacagtcacctccgtgtacagcccagtacccgaggatgcccctctggggactgtcatcgctttgctcagtgtgactgacctggatgctggcgagaacgggctggtgacctgcgaagttccaccgggtctccctttcagccttacttcttccctcaagaattacttcactttgaaaaccagtgcagacctggatcgggagactgtgccagaatacaacctcagcatcaccgcccgagacgccggaaccccttccctctcagcccttacaatagtgcgtgttcaagtgtccgacatcaatgacaaccctccacaatcttctcaatcttcctacgacgtttacattgaagaaaacaacctccccggggctccaatactaaacctaagtgtctgggaccccgacgccccgcagaatgctcggctttctttctttctcttggagcaaggagctgaaaccgggctagtgggtcgctatttcacaataaatcgtgacaatggcatagtgtcatccttagtgcccctagactatgaggatcggcgggaatttgaattaacagctcatatcagcgatgggggcaccccggtcctagccaccaacatcagcgtgaacatatttgtcactgatcgcaatgacaatgccccccaggtcctatatcctcggccaggtgggagctcggtggagatgctgcctcgaggtacctcagctggccacctagtgtcacgggtggtaggctgggacgcggatgcagggcacaatgcctggctctcctacagtctcttgggatcccctaaccagagcctttttgccatagggctgcacactggtcaaatcagtactgcccgtccagtccaagacacagattcacccaggcagactctcacggtcttgatcaaagacaatggggagccttcgctctccaccactgctaccctcactgtgtcagtaaccgaggactctcctgaagcccgagccgagttcccctctggctctgccccccgggagcagaaaaaaaatctcaccttttatctacttctttctctaatcctggtttctgtggggtttgtggtcacagtgttcggagtaatcatattcaaagtttacaagtggaagcagtctagagacctataccgagccccggtgagctcactgtaccgaacaccagggccctccttgcacgcggacgccgtgcggggaggcctgatgtcgccgcacctttaccatcaggtgtatctcaccacggactcccgccgcagcgacccgctgctgaagaaacctggtgcagccagtccactggccagccgccagaacacgctgcggagctgtgatccggtgttctataggcaggtgttgggtgcagagagcgcccctcccggacagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454960 - DNA, 4594 bp, Homo sapiens
atgaaagcgagctcagggaggtgcgggctggtgcggtggctgcaggtactgttgcccttcctgttgtctttgttccccggggctctcccagtccagatccgctattcaattccagaggagctggccaaaaactcggtcgtaggaaacctcgccaaggatctggggctcagcgtccgggacttgccagcccggaagctgcgggttagcgcggagaaggaatatttcacagtaaacccagaaagcggagacttacttgtgagtgacagaatagaccgagaacagatatgcgggaagcagcctctgtgtgttctggatttcgatactgtcgctgaaaatccactaaatattttctacatagcagtaattgtgcaggatataaatgataataccccgctattcaaacagactaagattaatttaaaaattggcgaatccactaagccaggtacaacatttccacttgacccagccctggattcagatgttggtcctaactcactacaaagataccaccttaatgacaacgagtactttgatctcgctgagaaacagactccagatggtcgtaaatatcctgagttgattctaaaacactctctggacagagaagagcacagtttacatcaattggtcctcacagctgtggatggcggagacccacctcaaagtggcacgacccaaatccgaatcaaagtcacggatgccaacgataaccctccagtgttcagccaggacgtgtacagggtcaccctgagggaggacgtgccgccgggcttctttgtgcttcaagtgacagccaccgaccgggatgaaggcataaacgcagagatcacctactcctttcataatgtggacgaacaagtgaaacactttttcaacttaaatgaaaaaacaggagaaatcacgacaaaggatgatttggattttgagattgcaagtagttacactctgagtatcgaagcaaaagatcctggagatctagcagcccactgcagtatccaagttgaaattcttgatgacaacgattgtgcacctgaagttattgtgacttcagtatctactcccctaccggaggattcgccaccaggaacagtgatcgccttgataaaaacgagagacagagactctggagaaaatggagaagtttactgccaagtgttgggaaatgccaagtttattttgaaatcttcctcaaagaactattacaaactagtgacagacggcgctctggaccgggaggagatcccagaatacaatctcaccatcacagccaccgacgggggcaagccgcccctctcctccagcataattgtcaccctgcacatctccgacgtcaacgataatgccccagttttccaacagacttcctacatggttcacgtggcagagaacaatcctcctggcgcctctatcgctcaaatcagtgcctctgaccctgacttgggccccagtggccaagtttcctactccatcgtagcgagcgacctgaagccgcgggagattttatcctacgtgtccgtgagcgcgcagagcggggtggtgttcgcgcagcgcgccttcgatcatgagcagctgcgcgccttcgagctcacactgcaggcccgcgaccagggctcgcccgcgctcagcgccaacgtgagcctgcgcgtgttagtgggcgacctcaatgacaatgcgccacgggtgctgtaccccgcgctggggcctgatggctccgccctcttcgatatggtgccacgcgccgcagagcccggctacctggtgaccaaggtggtggcggtggacgcagactcaggacacaacgcttggctgtcctaccacgtgctgcaggccagcgagcccgggctcttcagcctggggttgcgcacgggtgaggtgcgcacagcgcgtgccttgggcgacagggacgcggcccgccagcgcctgctggtcgctgtgcgtgatggaggacagccgccactctccgctacggccacgctgcacctaatcttcgcggatagcctgcaagaggtattgccagacctcagcgaccgccgggagccctctgacccccaggcaaaactgcagttttacctggttgtggccttggccttgatctcagtgctcttcttcctcgcggtgattctggcaatctccctgcgcctgcgactctcttccaggtcagatgcttgggactgttttcagcctggtctcagctccaagcctggacctggggttctccccaattacagtgagggtacattgccctattcctacaacctgtgtgttgcctcacaatcagccaagacagagttcaattttctgaacataaccccggaattggttcccgcgcaagatctcgtctgtgacaatgcctcttgggaacaaaatacaaatcatggagccgctggggtcccttttgcctcagatactattttgaagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454961 - DNA, 4719 bp, Homo sapiens
aaagtgcccaggctacagagacaccctgaagccacagaaagacaaaggaaccggttgaaacacacaacgtgtccagtgaggactttgcagaattctgtaaccagactacaatggccgctcaaaggaatcgctcaaaggaatcaaaggattgcagcgggctggtcctgctctgccttttcttcgggattccatgggaggctggagcccggcagatctcctactcaattcctgaggaattagagaaaggctctttcgtgggcaacatctccaaggacttgggtctggcgccccgggagctggcggagcgcggagtccgcatagtctccagaggtaggacgcagcttttctctctgaacccgcgcagcggcagcttgatcaccgcgggcaggatagaccgggaggagctctgcgctcagagcgcgcggtgcgtggtgagttttaatatccttgtggaagacagggtgaaactttttgggatagaaatagaagtaactgatatcaatgacaatgctccaaaattccaagcagaaaatctagacgtaaaaattaatgaaaatgtcgctgcgggaatgcgttttcctctcccggaagctattgatccggatgtgggcgtgaactccctgcagagctatcagctcagccccaataagcacttctccctaagagttcagagccgtgccaatggcgtcaagtacccggagctggtactggagcactccctagatcgcgaggaagaggccattcaccacctggtcctcaccgcctccgacgggggtgaccctctccgatctggcactgtccttgtcagtgtgactgtcttcgatgcaaatgacaacgcgccggtcttcaccttgccagaataccgagtgagtgttcctgagaatttgcctgtgggcactcagctgctgacagtcacagccaccgacagggacgaaggtgccaatggagaagtgacatattcattccgaaaattacctgacacgcaattgttgaagttccaactaaacaaatatactggagaaataaaaatatcagaaaatctagattatgaagaaaccggtttctatgaaatagaaatacaagcagaagatggaggagcatatcttgcaactgcaaaagtgttgattacagtagaagatgtaaatgacaacagtccagagctgaccatcacgtctctatttagtccagtgactgaagattcacctctgggaacagtcgtagcccttttaaatgtgcatgatttagactctgagcagaatggacaggtaacctgttccattttggcgtatctaccatttaaattagaaaagtccattgacagttattacagattggtgatacacagagcccttgacagggaacaggtatcctcttacaatatcacagtgacagccacagatgggggaagtcctcctctatcaacggaagctcactttatgctacaagtggcagatatcaatgacaacccacctaccttctctcaagtctcctactttacctatatcccagagaacaacgccaggggtgcctccatcttctcagtgacagcgctggacccggacagcaaagagaatgcccagattatttactccctggctgaagacaccatccagggggtacctctgtcctcatacatatccatcaactcagacactggcgtcctgtatgcactcagatccttcgactatgagcagtttcatgagctacagatgcaggtgacagccagcgacagcggggatcctccactcagcagcaacgtgtcgttgagcctgtttgtgctggaccagaacgacaatgcgcccgagatcctgtaccccgccctccccacagacggttccacaggcgtggagctggcgccccgctccgcagagcccggctacctggtgaccaaggtggtggcggtggacagagactccggccagaacgcctggctgtcctaccgtctgctcaaggccagcgagccgggactcttcgcggtgggggagcacacgggcgaggtgcgcacggcgcgagccctgctggacagagacgcgctcaagcaaagcctcgtagtggccgtccaggaccacggccagccccctctctccgccactgtcacgctcaccgtggccgtggccgacagcatcccccaagtcctggcggacctcggcagcttcgagtctccagctaactctgaaacctcagacctcactctgtacctggtggtagcggtggccgcggtctcctgcgtcttcctggccttcgtcatcgtgctgctggcgcacaggctgcggcgctggcacaagtcacgcctgctgcaggcttcaggaggcggcttgacaggtgtgtccggctcgcactttgtgggcgtggacggggttcgggctttcctgcagacctattcccacgaggtctctctcaccgcggactcgcgaaagagtcacctgatcttcccccagcccaattatgcggacacgctcatcagccaggagagctgtgagaaaaacgatcctttgtctttgttagatgattcgaagtttcctatagaggataccccattggttccacaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454962 - DNA, 4717 bp, Homo sapiens
gcggggaaagggagataggtgtctccagctgctgtggctgtttggggcgggtcggcttcatccgcgtctcaggagcaagtagagaattagcgggcggcagcaatgctccgcaaggtgagaagctggacagaaatctggcggtgggctacccttttgttcctcttttaccacctgggttacgtttgtgggcagatccgctacccggtcccagaggagtcacaggaagggacttttgtagggaatgtcgctcaagatttcctgctggatacggacagtctgtcagctcgcaggctgcaggtcgctggagaggtgaaccaaagacacttccgtgtggatttggacagcggagccctgctcatcaagaacccaatcgaccgagaggcactgtgtgggctcagtgccagctgcatcgtgcccctggagtttgtcaccgaaggtcctttggaaatgtaccgagcagaggtagagatcgtagatgtgaatgatcacgccccccgttttccgcggcagcagctggacttggaaattggggaggcagctcctccaggacagcgtttcccgttggaaaaggctcaggatgcagatgtggggagcaattcgattagcagctataggctgagctccaatgaacactttgcactggatgtgaagaagcgcagcgacggcagcctggtcccagagctgctcctggagaagcctttggatcgagagaagcaatcggactaccgcctggtgctgactgctgtcgatggagggaacccgccgagatctggcaccgcagagctccgggtatccgtgctggacgtaaacgacaacgccccagccttccagcaatccagctacaggattagtgtgttggagagcgcaccagcgggcatggtgctcatccagctcaatgcctcagacccggacctgggtcccagtggtaacgtcaccttttatttcagtggtcatacccctgatcgtgtaagaaacctctttagcctgcaccccactactggaaagcttactcttttggggcccctagactttgagagtgagaattactatgaatttgatgtgcgggctcgcgatgggggttctccagccatggagcaacattgcagccttcgagtggatctgctggacgtaaatgacaatgccccttacatcacagtgacctcagagcttggaaccctccccgagagtgcagaacctggcactgtggtggcacttatcagtgtgcaggatccagactcagggtcaaacggagatgtgagcctccgcattcctgaccacttgccatttgccctcaagtctgccttcaggaaccagttctccctggtgactgctggacccttggatcgagaggccaaatctagctatgacatcatggtcactgcttctgatgctgggaaccctcctctcagtacccacagaactattttcctcaatatttcagatgtgaatgataatccaccctctttctttcagaggtcacatgaggtgtttgttcctgagaacaatcgcccaggggacctgctttgctcccttgcagcctctgacccagactctggcttgaatgcgcttatctcctactcactcctggagcccaggaatcgagatgtatcagcttcctctttcatctctctgaacccccagacaggagctgttcatgctactcgatcctttgactatgagcaaacccagacactgcagtttgaggtgcaggcccgggatcggggcaacccaccccttagcagcactgtaacagttcgtctatttgtgctggacctcaatgacaatgctccagctgtgctccgtcctcgggcccggcctggttccttatgtccccaagcactgcctccatcagttggtgctggccacctaatcacaaaggtgactgctgtggacttggattcaggttacaatgcttgggtttcctatcagctcctggaggccccagatcccagcctgtttgcagtctctcgatatgctggggaggtgcggacggctgttcctatcccagctgacctcccaccacagaagctggtcattgtggtaaaggatagtggtagtccaccactctctacctctgttactctcttagtgtccttagaggaagacactcatccagttgtcccagatcttcgagaatcttcagctccaagggaaggagaatctcgtctaaccctctacttggctgtgtccctagtggcaatttgctttgtctcctttggctcattcgtggcactactctctaagtgtcttcgtggggcagcctgtggagtcacatgctttcctgctggcacctgtgcctgtctcaccagatctcgaaggagggaggggcttcccccttccaatgggatcctccgaatccagctagggtcagatgaccctatcaagtttgttgatgtgggaggccactctcatggctgtacacccttggcttctgcacccactcggagtgatagcttcatgatggtgaagtcacccagtgcacctatggcaggggagcctgttcgcccaagctgcccaccctctgatcttctctatgggctagagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454963 - DNA, 4864 bp, Homo sapiens
agaatgggctctaggcgccgctgctcaccaatcagggaatgggaagctgcgcgccattgagtccctccctcccccgcctctaccacacaaagcggaatgagatggatactcacagatcctgacactggagacttagaagtattttccttcgctttctgatatattttggatgtagtcggcctaggacttcatagatacataagccgattcacaaccaaccagctcgagaaaccgcggaatatcggcttagagcctgccatggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccccgggagctggcgaagcgcggagtccgcatcgtctccagagggaagacacagcttttcgctgtgaatccgcgaagcggcagcttgatcacggcaggcaggatagaccgggaggagctctgtgagacggtgtcctcctgttttttaaatatggaacttctcgtggaagacaccttgaagatttacggagtggaggtggaaataatagatattaatgataacgcccccagcttccaggaggacgaagtggagataaaagtcagtgagcacgcaattcctggggcgcgatttgctcttcctaatgctagggatccagatgtgggcgtgaactccctccagagctaccagctcagccctaataattacttttccttgcaactgcggggcagaacggatggggccaagaatccagagctagtactggagggaagcctggaccgagagaaagaggctgctcacctgctcctcctcacagctttagatggaggcgatcccatccgaaagggcgcagttcccattcgtgtggtggtcctcgatgtaaatgatcacatcccaatgtttacacagtccgtatatcgcgtgagtgttccagaaaacatcagctccggaactcgggtgctgatggttaatgcaacggatccagacgagggaatcaacggggaagtaatgtattcatttcggaacatggaaagcaaggcttctgaaatattccaattggattcacaaactggagaagttcaagtacgggggtctctggattttgaaaaatatagattctatgagatggaaattcaaggccaagatggtggaggtctctttaccaccacgacgatgttgatcactgttgtggatgtgaatgataacgctccagaaataactatcacctcttctattaattcaattctggaaaactctcctccaggtacagtgattgctcttctaaatgtgcaagatcaagattctggagaaaatggtcaagtctcctgttttattcctaaccacctgccttttaaattagaaaagacttatggaaattattacaaattgataacaagcagagtgctggacagggagttggtccagagctacaatataacgttgacagccacagaccagggaagcccgcctttgtctgcagaaactcatgtctggctgaatgtggcagatgacaacgataaccctcccgtttttcctcactcctcttactctgcctacattcccgaaaacaaccccaggggtgcctccatcttctcagtgaccgccctcgacccggacagcaaacagaatgccctggtcacttactctctgacggatgacactgtccagggggtgcctctgtcctcctatgtctctattaactccaacactggtgttctctatgccctacaatccttcgactatgagcagtttcgagacttagaactgagagtgatagcacgtgacagcggggacccgcccctcagcagcaacgtgtcgctgagcctgttcgtgctggaccagaacgacaatgcgcccgagatcctgtaccctgccctccccacagacggctccactggcgtggagctggcgccccgctctgcggaacctggctacctggtgaccaaggtggttgcggtggacaaagattcaggccagaacgcctggctgtcctatcgcctgcttaaggccagcgagccgggactcttcgcggtgggggagcacacgggcgaggtgcgtacagcgcgggcactgctggacagagacgcgctcaagcagagcctcgtggtggccgtccaggaccacggccagccccctctctcggccaccgtcacgctcaccgtggctgtggccgacagcatccccgaagtcctggcggacctcggcagcctcgagtctctggctaactctgaaacctcagacctctcgctgtacttggtggtggcggtggccgcagtctcctgcatcttcctggtctttgtcatcgtgctgctggcactcaggctgtggcgctggcataagtcacgcctgctgcaggcttctgaaggcgggttggcaggtatgcccacgtcacattttgtaggcgtggacggggtacaggctttcctgcaaacctattcccacgaggtctctctcattgcggactcgcagaagagtcacctgattttcccccagcccaactatggggacacgctcatcagccaggagagctgtgagaaaagcgagccactcttgatagctgaagactcagctatcattttaggcaaatgtgacccgacaagtaatcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454964 - DNA, 4597 bp, Homo sapiens
atggcagctccaaccaaatgccagctccgcggaagattagtcctgctatgctcgctcctggggatgctatgggaggccagggccagtcagattcgctactcagtgcctgaagagacagaaaagggctatattgtgggcaacatctccaaggacctggctctggagccccgggagctggcggagcgccgagtccgcatcgtctctagaggtaggacgcagcttttctctctgaacccgcgcagcggcaccttggtcaccgcgggtaggatagaccgggaggagctctgtgctcagagcccgcggtgtctggtgaactttaaagtcctggttgaagacagagtgaaactgtacggaatagaaatagaagtaactgatattaacgacagcgccccaaagttccaggccgaaagtctggaagtaaaaattaacgaaatcgcggttcctggagcacgttatccacttccagaagctattgatccggatgttggcgtgaactccctccagagctaccagctcagccccaatcaccacttctccctgaacgtgcagactggagacaatggagccataaacccagagctggtgctggagcgcgccctggacagggaggaggcaactgcccaccacctggtcctcacggcctcggatggcggcgagccgcgtcgctccagcacagtgcgcatccatgtgacagtgttggatacaaatgataatgccccggtttttgctcaacggatttaccgagttaaagtccttgagaacgtgcccccaggcacctggctgcttactgcaacagccagcgacctggatgagggaatcaacggaaaagtggcatacaaattctggaaaattaatgaaaaacaatctctgctattccagcttaatgaaaatactggggaaatatcaacagcaaaaagtctagattatgaagaatgttcattttatgaaatggaaatacaagctgaagatggtgggggattgaaagggtggacaaaagtgctcatttcggtggaagatgtaaatgacaatagacctgaagtgaccattacatctctgtttagcccagtgagagaagacgcacctcagggaacagtaattcttcttttcaatgctcatgaccgagactccgggaagaatggtcaagttgtctgttctatccaggagaatctatcttttacattagaaaattcagaagaagattattacagattgttgacggcccaaattcttgaccgagaaaaagcctcagaatataatatcacggtgactgcaacagacagaggaactccgcccctgtccacagaaattcacatcaccctgcaagtgactgacatcaatgataatccacctgctttctctcaagcctcctactcagtctacctcccggaaaacaacgccagaggtacttccatcttctccgtgattgcctatgaccctgatagcaatgagaattctagagttatttactccttggcagaggataccatccaagggtctcctctctccacctatgtctctattaactcagacactggtgtgctgtatgctctgtgctcctttgactatgagcagtttagagatttgcaaatgcaggtgacggcaagtgacagtggaagcccaccacttagcagcaatgtgtcattgagactgtttgttttggaccagaatgacaatgccccagaaatcctgtaccctgccctccccactgatggttctactggtgtggagctggcaccccgctctgcagagcctggctacctggtgaccaaggtggtggcagtggacagagactcaggccagaatgcttggctctcctaccgcctattcaaggccagtgagccagggctcttctcggtggggctgcacacaggtgaagtgcgcacagctcgggccctgctagatagagatgcgctcaaacagagccttgtggtggctgtacaggaccatggccagccccctctctcggccactgtcacgctcacagtagccatagctgacagcatcccagacatcctggctgacctgggcagtcttcagatccctgcagacctggaggcctcagaccttaccctctacctcgttgtggctgtggcagtcgtctcctgtgtcttcctcaccttcgttatcacgctgctggccctcaggctgaggcactggcactcctcgcatctgctgcgggctaccagtgatgggttggctggtgtgcccacctcacactttgtgggtgtagatggggttcgagctttcctacagacctattctcaggagttctccctcaccgctgactcaaggaagagtcacctgatcttcccccagcccaactatgcagacacactcatcagccagcagagctgtgagaaaaatgagcctttgtgcgtctctgttgattccaagtttcctatagaagacacccctttggttccgcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454965 - DNA, 4582 bp, Homo sapiens
atgcagagagccagagaagccgaaatgatgaaaagtcaggtactgtttcccttcctgctgtctttgttctgcggggccatctcccagcagatccgatacacgattccagaggagctagccaacggctcacgggtggggaaacttgccaaggatctggggctcagtgtccgggagttgccaactcgaaaactgcgggttagtgcagaggattatttcaacgttagtttggagagcggggatttgttagtgaacggtaggatagatcgagagaagatttgcggaaggaaacttgagtgtgcactagaattcgaaacggtcgctgaaaacccaatgaatgttttccacgtggttgttgtaatccaagatattaatgacaatgcaccacgtttcgttgcaaaaggcattgacttagaaatttgtgagtcagccttacccggggtaaaattctctctggattctgctcaagatgcagatgtggaaggcaattcactgaagttatacaccatcaaccccaatcaatacttctctctgtcaacgaaggaaagtcctgatggaagtaaatatccggtattactgctggaaaaacctctagacagggaacatcagagctctcatcgcttaatcctgactgccatggatggcggggacccgcctctaagcggcaccacccatatctggatccgagttacggatgccaatgataatgctcccgtgtttagccaggaggtatacagggttagcctccaagaaaacgtaccgtggggaacctccgtgctgcgggtgatggccacagaccaggatgagggcattaatgcagagatcacctatgccttcctcaattccccaataagtaccagcctcttcaatctcaatccaaatactggcgacatcacaaccaatggcacattggattttgaagagacaagtagatatgtgttgagtgtggaagctaaggatggaggagtacacacagctcactgtaatgttcaaatagaaattgttgacgagaatgacaatgccccagaggtgacattcatgtccttctctaaccagattccagaggattcagaccttggaactgtaatagccctcataaaagtgcgagacaaggattctgggcaaaatggcatggtgacatgctatactcaggaagaagttcctttcaaattagaatccacctcgaagaattattacaagctggtgattgctggagccctaaaccgggagcagacagcagactacaacgtcacaatcatagccaccgacaagggcaaaccagccctttcctccaggacaagcatcaccctgcacatctccgacatcaacgacaatgcacctgttttccatcaggcctcctatgtggtccacgtgtctgagaacaacccacctggcgcctccattgcacaagtaagcgcctccgacccggatttgggacccaacggcagagtctcctactctattctggccagtgacctggagccgcgggagctgttgtcctacgtgtccgtgagcccgcagagcggggtggtgttcgcgcagcgcgccttcgaccacgagcagctgcgcgccttcgagctcacactgcaggccagggaccagggctcccccgcgctcagcgccaacgtgagcctgcgcgtgttggtgggcgacctcaatgacaatgcgccacgggtgctgtaccccgcgctggggcctgatggctccgccctcttcgatatggtgccacgcgccgcagagcccggctacctggtgaccaaggtggtggcggtggacgcagactcaggacacaacgcttggctgtcctaccacgtgctgcaggccagcgagcccgggctcttcagcctggggttgcgcacgggtgaggtgcgcacagcgcgtgccttgggcgacagggacgcggcccgccagcgcctgctggtcgctgtgcgtgatggaggacagccgccactctccgccaccgccacgctgcacctaatcttcgcggatagcctgcaagaggtattgccagacctcagcgaccgccctgagccctctgacccccagacggaactgcagttttacctggttgtggccttggccttgatctcagtgctctttctcctcgcggtgattctagcgatcgccctgcgcctgcgacgttcctccagcctcgacactgagggctgctttcaaaccggtctctgctccaagtctgggcccggggttcctcccaaccacagcgaggggactttgccctattcctacaatctatgtattgcctctcattctgcaaagacagagtttaattctctcaacctgacaccggaaatggctccccctcaggatctgctgtgtgatgatccttctatggttgtatgtgccagtaatgaagatcacaaaatcgcttatgacccttctttgtcttcgcaccaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454966 - DNA, 4633 bp, Homo sapiens
atggggcccaagacactcccacagctcgctgggaaatggcaagtgctgtgcatgttgtccttgtgctgctggggctgggtgtctgggcagcttcgttactcagtggtggaggagtctgagccggggacgctggtggggaatgttgctcaggatctgggcttaaagatgacagatctgttgagccggcggctgcaattgggctctgaggagaatgggcgctatttttccctgagcttgatgagtggtgccctggcagtgaatcaaaagattgaccgagaaagcctatgtggagccagcaccagctgcctgctgccagtgcaggtggtgactgaacaccccctggagctaatccgtgtagaggtagagatcctggatctcaatgacaactctcctagctttgccacccctgagcgagagatgcgcatctcagaatcagcagcatctggggcacgattcccactggacagtgcccaggatccggatgtgggcaccaatactgtgagcttttacactctaagccccaacagccacttctctctgaatgtgaagaccctaaaagatgggaagccattcccagagctggtgctagagcagcagctggatcgtgaagcccaggcaagacatcagctggtgcttactgctgtggatggggggaccccagcccgctcagggaccacccttatctctgtcatcgtgctggacatcaatgataatgctccaaccttccaatcctcagttctacgtgtgggaatcccagagaatgcacccattggtactctgctgctccgcctcaatgccactgatccagacgagggcaccaacggccaactagactattcttttggagaccacacatctgaggcagtgcggaacctctttggcctagaccctagcagtggggcaatccatgtgttgggtcccatagactttgaggagtcacgtttctatgaaattcatgcaagagcccgtgaccagggacagcctgccatggagggccactgtgtgattcaagtggatgtgggggatgtcaatgacaatgccccagaggtgctattggcctctttggccaaccctgtcctagagagcacaccagtgggcacagtagtggggttgtttaatgtgcgagaccgggactcaggtagaaatggtgaagtgagccttgatatctctccggacctgccatttcagattaagccttctgagaaccactactcgctgctaaccagccagcctttggaccgggaggccacatcccactatatcatcgagctgctggccagcgatgctggttcaccttccctacacaaacatctcaccatcaggctcaacatttcagatgtcaatgacaatgcaccccgcttcaaccagcagctttacactgcttacatcctagaaaaccggcctccgggctcccttctttgcactgtggctgcctcagatccagacactggggataatgcccgcctcacctactccattgtaggaaatcaggttcagggagccccagcctcctcctttgtgtatgtcaacccagaggatggacggatctttgcccagcgtacctttgactatgaattgctgcagatgctgcagattgtggtgggggttcgagactccggctctcccccattgcatgccaacacatctctgcatgtgtttgtcctagacgagaatgataatgccccagctgtgctgcacccacggccagactgggaacactcagccccccagcgtctccctcgctctgctcctcctggctccttggtcaccaaggtgacagccgtggatgctgatgcaggccacaatgcgtggctctcctactcactgttgccacagtccacagccccaggactgttcctcgtgtctacacacactggtgaggtgcgcacagcccgggccttactggaggatgactctgacacccagcaggtggtggtcctggtgagggacaatggtgacccttcactctcctccacagccacagtgctgctggttctggaggatgaggaccctgaggaaatgcccaaatccagtgacttcctcatacaccctcctgagcgttcagaccttaccctttacctcattgtggctctagcgaccgtcagtctcttatccctagtcaccttcacctttctgtcagcgaagtgccttcagggaaacgcagacggggacgggggtggagggcagtgctgcaggcgccaggactcaccctccccggacttctataagcagtccagccccaacctgcaggtgagctcggacggcacgctcaagtacatggaggtgacgctgcggcccacagactcgcagagccactgctacaggacgtgcttttcaccggcctcggacggcagtgacttcacttttctaagacccctcagcgttcagcagcccacagctctggcgctggagcctgacgccatccggtcccgctctaatacgctgcgggagcggagccagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454967 - DNA, 4597 bp, Homo sapiens
atggcgcctccgcagaggcatccgcagcgcagcgagcaggtcctgctcctcacgctcctggggacgctgtggggggccgcggcagcgcagatccgctactctattcccgaggagctggagaaaggctccttcgtaggcaacatcgtcaaggatctgggactggagccccaggagttggcggagcacggagtccgcatcgtctccagaggtaggatgcagcttttctctctgaatccgcgaaacggcagcttggtcaccgcgggtaggatagaccgcgaggagctctgtgctcagagcccgcggtgtctggtgagttttaacatccttgtcgaggataaactgaatctttatcccgtggaagtggaaatagtggacattaatgacaatacaccccgattcttaaaggaagaattggaagtgaaaattctcgaaaacgcagctccatcctctcgttttccactaatggaggtctatgaccctgatgtgggaatgaactcccttcagggatttaagctcagtggtaatagtcacttctcagtggacgtgcaaagcgaagcccatgggcccaagtacccggagctggtgctggagggcacactggaccgggaaggagaagccgtttaccgcctggtccttactgccatggatggcggcgaccctgtccgctcaagcgtcgcccaaattctggtaacagttctagatgtgaatgacaacactccaatgtttactcagcctgtctaccgtgtaagtgttcctgaaaacctgccagtaggcacaccagtgttggcagtgactgccaccgaccaggatgaaggagtccacggggaagtaacttattcctttgtgaagattacagaaaagatctcacaaattttctgtttgaatgttttgactggagaaatttcaacttctgcaaatctagactatgaggactcgagtttttatgagctgggtgttgaagcccgggatgggccaggtcttcgagacagagcgaaagtcttaataactatcttggatgtcaatgataatgtaccagaagtggttgttacatctggaagcagaacaattgctgaaagtgcacctccaggaacagtaatcgccctttttcaagtgttcgatcgagactctggcctgaatggcctggtaacctgttccatcccgagaagtctcccatttgaattggaaaaatcagttggcaattattatcgattagtgacaaatgcagctctagaccgggaagaggtattcttgtacaacatcactgtgacagccacggacaaaggaacaccacctctgtctacagaaacaatcatctctctaaatgtggcagacaccaacgacaacccgcccaccttcccccattcatcctactcagtctatgtccttgaaaacaaccccaggggtgcctccatcttctctgtgaatgcactggaccctgacgtggaccagaacgcccaagtctcctactcactggcagaagacaccctccagggggcgcccctgtcctcctacgtgtccatcaactccgacactgggattctgtacgccctgcgctccttcgactatgagcagttgagagacctacagctgtgggtgacagccagcgacagcggggacccgcctcttagcagcaacgtgtcactgagcctgtttgtgctggaccagaatgacaatgcgcccgagatcctgtaccccgccctccccacagacggttccactggcgtggagctggcgccccgctccgcagagcccggctacctggtgaccaaggtggtggcggtggacagagactcgggccagaacgcctggctgtcctaccgcctgctcaaggccagcgagccaggacttttctcagtgggcctgcacacgggcgaggtgcgcacggcgcgcgccctgctggacagagacgcgctcaagcagagcctagtggtggccgtccaggaccacggccagccccctctctccgccactgtcacgctcaccgtggccgtggccgacaggatccccgacatcctggccgacctgggcagcctcgagccctccgccaaacccaacgattcggacctcactctgtacctggtggtggcggtggccgcggtctcctgcgtcttcctggccttcgtcatcgtgctgctggcgctcagactgcagcgctggcacaagtcacgcctgctgcaggcttcgggaggtggcttagcgagcatgcccggctcgcactttgtgggcgtggaaggggttcgggctttcctgcagacctattcccacgaggtctcactcactgcagactcgcgtaagagtcatctgattttcccccagcccaactatgccgacacgcttatcaaccaggagagctatgagaaaagcgagcctcttctgataactcaggatttacttgaaacgaaaggagaacccaggcaacttcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454968 - DNA, 2445 bp, Homo sapiens
attggctgggactctgtgtgccgctgtcggccaatgaagacgctggagatcgggcccctgcccgtcccctttctgcgccccgggatgaggcagagactgaacagccggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactgcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454969 - DNA, 8943 bp, Homo sapiens
  misc_feature (8931)..(8931): n is a, c, g, or t
  misc_feature (8933)..(8934): n is a, c, g, or t
  misc_feature (8939)..(8939): n is a, c, g, or t
  misc_feature (8941)..(8942): n is a, c, g, or t
cagggcagccccagctcagactccccagcgccagcctttacaccgcttcctcctcggaaaaagaagaattttttcttgaactggaactgcaactaaagtccgttcggagatccaaaaatctgcaatacagaggttatttgtaacccggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacacgatttatattaggatctgcccatgatgcggatattggtagcaacacactgcagaattaccaactcagtcccagtgatcatttctcactgataaataaagagaaatcagatggcagtaaataccctgagatggtattgaagacacctttggacagagaaaagcagaaatcctaccacttgactttgactgccttggactttggagctccacccctaagcagcactgcacagatacacgttctagtgactgatgccaatgataatgctccagtgttcagtcaagacgtatacagggtgagcctttcagaaaacgtgtacccggggaccacggtgctacaggtgactgccacggaccaggatgagggtgtcaatgccgagattactttctctttcagtgaagctagccagatcacccaatttgacctgaactctaacaccggggaaattactgttttaaatacattagattttgaagaagtcaaagaatattccatagttttggaagcaagggacggtggaggaatgattgcgcaatgcacagtggaggtagaagtcatagatgaaaatgacaacgccccagaagtgatattccagtctctacccaacctaattatggaggacgccgagctgggaacacatattgctttgctcaaagtccgtgacaaggattccagacacaatggagaagtgacttgtaaattggaaggtgatgttccatttaaaatattaacttcttcaagaaacacgtataaattagtgacagatgctgttctagaccgcgagcagaatccagagtacaatataaccgttacggcaacagatcggggcaagcctcccctctcctccagttccagcatcaccctgcacattggtgatgtaaatgacaacgctccggttttctcacagtcttcctatatagtccacgtggccgagaacaacccgcctggagcctctatttcacaagtcagggcttctgatccggacttggggcccaacggccaagtctcttactgcatcatggccagtgacctggagcagcgggagctgtcatcctacgtgtccataagcgcggagagcggggtggtgttcgcgcagcgcgccttcgaccacgagcagctgcgcgccttcgaactcacactgcaggcccgcgaccagggctcgccagcgctcagcgcgaacgtgagcctgcgcgtgttagtggacgaccgcaacgacaatgcgccacgggtgctgtaccccgcgctgggtcccgacggctctgcgctcttcgatatggtgccgcacgctgcagagcctggctacttggtgaccaaggtagtggcggtggacgcagactcaggacacaacgcctggctgtcctaccacgtgctgcaggctagcgagcccgggctcttcagcctggggctgcgcacgggcgaagtgcgcacagcgcgtgccttaggcgacagggacgccgtccgccagcgccttctggtcgccgtgcgtgacggtggacagccaccactctcggccactgccacgttgcacctggtcttcgccgacagcttgcaggaggtgctgccggatatcactgaccgccccgacccctctgacctccaggctgagctgcagttttacctagtggtggccttggccttgatctcagtgctcttcctcgtggccatgattctggccattgccttgcgcctgcgacgctcctccagccccgcctcctggagctgcttccagcctggtctctgtgttaaatccgaatccgtggttccccccaactacagcgaggggactttgccttattcctacaatctatgtgttgcacatacaggaaagacggagtttaatttcctaaaatgtagtgagcagttgagttcaggacaagacatactttgcggtgattcatctggggccttatttccactttgtaattccagtgaattgacttcccatcaggtgagtttcctttaagtataatttaatgctcattgcctacccatttctccatattcacaagaaaatatacatatttgcaggaaaatatataatttttagatgtcatggatcattttaggaaagttgtagtcagttaaaaagctgtcatatcattctacaaaggaggagtaaagtaggagcaattgtgtggcccaacatttgtttgttttttagccaagcttagatttataaagcaatgagggtgtggttttaaccacaaagtgaaagtgttagacagttgttggctctctcctaaaaagtgaatgagatttttcctatacattttccttcttgttgactaatatatgatgaatacttttttcagcttggatataccataaatataaaaataataaagccaaagaatttaagctaaaattcaacacttttcttaactaatttaactggtatggtctccatagtagtccactgttttgtttcctgtgttaacttcccttttgtttcaaaagctcttagaataaggagtcaactggatttttatgtccatggaccccttgtgattatatgcagtgtacgctgtgtgtgcgtgtgtgtgtgtgtgtgtgtgagagagatccttttacttagaaaaaggtctactatgctcattagaagatcaaaagcagattctccttacttgtaacataggagtttcaggattaatctgtattcaagctcattctatatccttcatcaaagaaaagacaatgttttgtgtctgttgtccctctcacacacagccctaatatataatgtgtaactgccttatctgcagccctaaactaatatagctagaggtcttctaatcattctcctacctctaggaaagaaatatagtcttgaaaactgccaatctggtgtgcatacaaaatatatacaaaataccaaggaacattatatgagccttttgctaggtatatctaagcaactgcttcagttaatggccactttacaaattgctgaaagaaggaaacgtctttcgattcttttttttttctttttttttttttgagacagagtctctgtctgttactcaggctgtagtgcagtggcacaatgatagctccctccagcctcaaactcctgggctcaagcattccttctgcatcagcctcctgactagctggaactcaggctcatgccaccagacctggctaatttttctgttttcagtagagaaaatattttctttcactaatttaactggtatggtttccattgtctacccagttttccatatgcataagaaaatatattcacaggaaaatataaagttttcagatttcatgagtggttttaagaaagttttagtcagtgaaaaaactatcataccagtcttcaaaggaagggtgaaataagttcatctgctacgttgcccaggctggtcttgaagggaaacagacttttttgtagtcatacttatcctttggcttcttagtaagtattatatagtcattactttttgcagttttttagatcaaagtgttaatgtaggtaaagttaattttagaatatatgtaaaagtcaagtctgctttaaatttaatcatctctttggtgaaagggatgggatggagctttgctttttatcatatattcatctgtacctttcaagtattcaaatagaaaaatataaacaatgtaaataaaatagcaaaacaatgtaatatctcataaaactgcaatggtaaaagcatttatcctattgaaattccacaatttttatttgaaaatattatcgacatgtaattcaagtggcatttagaagaataatttaaaagcaacaactctatagaaagcttgtaaaatgattaagtagtttaaaccaaataaaacaatttctgagtcagtcatctccagtaggtctattttagtctcaagataaattcatttctggtgacaactgaagttcttagttatttgttagtatatattggagacatttacaataaagcttagagcacaatgggaaatgaaagtatcatgttttttttaagaccaaatgtattgcagaaatgtgagtaatttaatccgatgctacaatctgatcattctgatctaatctgatcatttaataacactaaataaaaccttcatctcacattctttggctgtttcttttaaaatatgggtttacggataaatcaaataaattcaaaacaaagtaataagcaaatgatttttttttctcagtaatctagtagagtattacatttagaagtaatctgtatctcagtgcagtaactatttaggactgtaagcgccgctgttcacctactggaagacaaatgcaaccgaaaacactcagatctcacacctcacgaagacccgcagatgccacaaactaactgctggactgcagcgaaacccgacccctgtttggaggcactccaggtttccggaggattgtcatctccatagctgcggcaagaaactaaataagacccatttatgcacagtgaagattctgagaggattctgcagcaaaacaacaatggccgctccacagagtcgccccagacgcggcgagctgatcctgctgtgcgcgctgctgggaacgctgtgggaaatcgggaggggacagattcgctactctgtgccagaagagacggacaaaggctccttcgtgggtaatatctccaaggacctggggctggacccccggaagctggcgaagcacggagtccgtatcgtctccagaggtaggacgcagctctttgctctgaacccgcgcagcggcagcttgatcaccgcgggcaggatagatcgggaggagctctgcgctcagagcccgcggtgtctgataaatattaacaccctggttgaggataaaggaaaactctttggggtagaaatagaaataattgatattaacgataataacccaaaattccaggtcgaagatctagaagtaaaaattaacgaaatcgcggttcctggagcacgttatccactcccagaagctgttgacccggatgtgggcgtgaactccctccagagctaccagctcagccccaatcaccacttctccctggacgtgcagactggagacaatggagccataaacccagagctggtgctggagcgcgccctggacagggaggaagaggctgctcaccacctggtcctcacggcctcggatggcggcaagccgcctcgctctagcacagtgcgcatccacgtgacagtgttggatacaaatgacaatgccccggtttttcctcacccgatttaccgagtgaaagtccttgagaacatgcccccaggcacgcggctgcttactgtaacagccagcgacccggatgagggaatcaacggaaaagtggcatacaaattccggaaaattaatgaaaaacaaactccgttattccagcttaatgaaaatactggggaaatatcaatagcaaaaagtctagattatgaagaatgttcattttatgaaatggaaatacaagccgaagatgtgggggcacttctggggaggaccaaattgctcatttcggtggaagatgtaaatgacaatagaccagaagtgatcattacgtctttgtttagcccagtgttagaaaattctcttcccgggacagtaattgccttcttgagtgtgcatgaccaagactctggaaagaatggtcaagttgtctgttacacacgtgataatttaccttttaaattagaaaagtcaataggtaattattatagattagtgacaaggaaatatttggaccgagaaaatgtctctatctacaatatcacagtgatggcctcagatctaggaacaccacctctgtccactgaaactcaaatcgctctgcacgtggcagacattaacgacaaccctcctactttccctcatgcctcctactcagcgtatatcctagagaacaacctgagaggagcctccatcttttccttgactgcacacgaccccgacagccaggagaatgcccaggtcacttactctgtgaccgaggacacgctgcagggggcgcccctgtcctcgtatatctccatcaactctgacaccggtgtcctgtatgcgctgcaatctttcgactatgagcagatccgagacctgcagctactggtaacagccagcgacagcggggacccgcccctcagcagcaacatgtcactgagcctgttcgtgctggaccagaatgacaacgcgcccgagatcctgtaccccgccctccccacagacggttccactggcgtggagctggcgccccgctccgcagagcgtggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagatgcgctcaagcagagcctcgtggtggccgtccaggaccatggccagccccctctctccgccactgtcacgctcaccgtagccgtggctgacagcatccccgaagtcctgaccgagttgggcagtctgaagccttcggtcgacccgaacgattcgagccttacactctatctcgtggtggcagtggctgccatctcctgtgtcttcctcgcctttgtcgctgtgcttctggggctcaggctgaggcgctggcacaagtcacgcctgctccaggattccggtggcagattggtaggcgtgcctgcctcacattttgtgggtgttgaggaggtacaggctttcctgcagacctattcccaggaagtctccctcaccgccgactcgcggaagagtcacctgatctttccccagcccaactacgcagacatgctcatcagtcaggagggctgtgagaaaaatgattctttgttaacatccgtagattttcatgaatataagaatgaagctgatcatggtcaggtgagtttagttctttgcttgcttttaatttccagatgaattttatttggcataaattatgttttgaaaaacattgtgaagatagttgaaaataatttttaaggtgtatcacagagttttgggtttattttggtggtgttactataaaattgaactctaatagtcataggttattgtttcatttgcttttaaacgacttggaaaagattgttcaaccattttaagccttccagtattttattcctattatcactcattcacttaagaagtagctacccgtccatactggtaattttgctattgtttgtgtgtgtgtgtgtgtgtgtgtgtgtgtgtgtgtgtgtgtatcccaaactagaacttcagaaaattatcaagaagtctaaagccttgttattagcttagcaaaagtaaaatatatctcagaatttttagggttatgtttagcatttgaacctgtaactaggctcttgtagatttcttcactttaaacctcttttctgagccctgtttctgtaccagtgcccttcaaaactttaatacttcttaccatccttcaaaacatgaacaaactttaaagatggatcttggtgggagatgagactggttactaaatattaagtatgtgagtcagtggtcacctgggctccatgcccatggagacatgaaatctaaagcctagaatgtccattgctcccccaaacaaaaaacaaaagcaaaaacattagatctgaattaaaatgtaattttaaactgttgaaagtgacttttgtaaaatatgtaagaacatatttcaatacaattccaattagctgtttcggttgtgcattgatgtgaagtggtgagaatgttgatattaagaaccaatgtttcaggtacacaagttctaaataagctgatcaattcaattaaagttattcagtcttggctggacacagtgcctcatgtctgaaatcccagcactttgggaggctggggcaggaggaccgcttgagccccgggggtttgaaactgcagtgagctatgatcatgccactgcactccagcctaggtggcagaactagaccctgtctctaaaaaaactattattaggccgggtgcggtggctcacgcctgtaatcccagcactttgggagactgaggtgggtggatcacctgaggtcaggagttcaagatcagcctggcaaacatggtgaaaccccgtctctactaaaaactacaaaaattagccaggcatggtggcatgcgcctgtggtcccagctactcgggaggctgaggcagaagaatcacttgaacccgggaggtggaggttgcagtgagcctcgatcctgtcactgcactccagcctgggcaacagggtgagactccgtctcaaaaaaaaaaaactantnntaatngnna

SEQ ID NO: 454970 - DNA, 3305 bp, Homo sapiens
gcacgcgcctgaagcacaaagcagatagctaggaatgaaccatccctgggagtatgtggaaacaacggaggagctctgacttcccaactgtcccattctatgggcgaaggaactgctcctgacttcagtggttaagggcagaattgaaaataattctggaggaagataagaatgattcctgcgcgactgcaccgggactacaaagggcttgtcctgctgggaatcctcctggggactctgtgggagaccggatgcacccagatacgctattcagttccggaagagctggagaaaggctctagggtgggcgacatctccagggacctggggctggagccccgggagctcgcggagcgcggagtccgcatcatccccagaggtaggacgcagcttttcgccctgaatccgcgcagcggcagcttggtcacggcgggcaggatagaccgggaggagctctgtatgggggccatcaagtgtcaattaaatctagacattctgatggaggataaagtgaaaatatatggagtagaagtagaagtaagggacattaacgacaatgcgccttactttcgtgaaagtgaattagaaataaaaattagtgaaaatgcagccactgagatgcggttccctctaccccacgcctgggatccggatatcgggaagaactctctgcagagctacgagctcagcccgaacactcacttctccctcatcgtgcaaaatggagccgacggtagtaagtaccccgaattggtgctgaaacgcgccctggaccgcgaagaaaaggctgctcaccacctggtccttacggcctccgacgggggcgacccggtgcgcacaggcaccgcgcgcatccgcgtgatggttctggatgcgaacgacaacgcaccagcgtttgctcagcccgagtaccgcgcgagcgttccggagaatctggccttgggcacgcagctgcttgtagtcaacgctaccgaccctgacgaaggagtcaatgcggaagtgaggtattccttccggtatgtggacgacaaggcggcccaagttttcaaactagattgtaattcagggacaatatcaacaataggggagttggaccacgaggagtcaggattctaccagatggaagtgcaagcaatggataatgcaggatattctgcgcgagccaaagtcctgatcactgttctggacgtgaacgacaatgccccagaagtggtcctcacctctctcgccagctcggttcccgaaaactctcccagagggacattaattgcccttttaaatgtaaatgaccaagattctgaggaaaacggacaggtgatctgtttcatccaaggaaatctgccctttaaattagaaaaatcttacggaaattactatagtttagtcacagacatagtcttggatagggaacaggttcctagctacaacatcacagtgaccgccactgaccggggaaccccgcccctatccacggaaactcatatctcgctgaacgtggcagacaccaacgacaacccgccggtcttccctcaggcctcctattccgcttatatcccagagaacaatcccagaggagtttccctcgtctctgtgaccgcccacgaccccgactgtgaagagaacgcccagatcacttattccctggctgagaacaccatccaaggggcaagcctatcgtcctacgtgtccatcaactccgacactggggtactgtatgcgctgagctccttcgactacgagcagttccgagacttgcaagtgaaagtgatggcgcgggacaacgggcacccgcccctcagcagcaacgtgtcgttgagcctgttcgtgctggaccagaacgacaatgcgcccgagatcctgtaccccgccctccccacggacggttccactggcgtggagctggctccccgctccgcagagcccggctacctggtgaccaaggtggtggcggtggacagagactccggccagaacgcctggctgtcctaccgtctgctcaaggccagcgagccgggactcttctcggtgggtctgcacacgggcgaggtgcgcacggcgcgagccctgctggacagagacgcgctcaagcagagcctcgtagtggccgtccaggaccacggccagccccctctctccgccactgtcacgctcaccgtggccgtggccgacagcatcccccaagtcctggcggacctcggcagcctcgagtctccagctaactctgaaacctcagacctcactctgtacctggtggtagcggtggccgcggtctcctgcgtcttcctggccttcgtcatcttgctgctggcgctcaggctgcggcgctggcacaagtcacgcctgctgcaggcttcaggaggcggcttgacaggagcgccggcgtcgcactttgtgggcgtggacggggtgcaggctttcctgcagacctattcccacgaggtttccctcaccacggactcgcggaagagtcacctgatcttcccccagcccaactatgcagacatgctcgtcagccaggagagctttgaaaaaagcgagccccttttgctgtcaggtgattcggtattttctaaagacagtcatgggttaattgaggtgagtttatatcaaatcttctttctttttttttttaattgctctgtctcccaagctggaatgcagcggtacgatcatagctcactgcagcctcaaactcctaggctcaagcaattatcccacctttgcctccggtgtaacagggactacaggtgcaagccacctactgtctgcctatctatctatctatctatctatctatctatctatctatctatctattactttcttgcctgtaatcccagtactttgggaggccgaggcgggtggatcacctgaggttgggagtttgagaccagcctgaccaacatggagaaaccccgtctatactaaaaaaatacaaaattagccgggcgtggtggtgcatgtctgtaatcccagctacttgggaggctgagtcaggagaattgctttaacctgggaggtggaggttgcaatgagctgagattgtgccattgcactccagcctgggcaacaagagtgaaactctatctcaaaaaaaaaaaaaaaaaactttatcctctagtttcatccattgatgacacttgctttaatcacttattacaatcacctccaaatgaagattttataattccattgtttcttctacagttgttaattggctttctaccttgaagaagagttttatattctctatatatgtttgtttctatgattctggaagcatggttttctattttattcaatgg

SEQ ID NO: 454971 - DNA, 2664 bp, Homo sapiens
acagcacaagggggtggaggtttggccctaaagcttcaggacaccaaagaaattcagtcgaacagcccaccagttctctccatagggacctgggtcccgtgaatgctggttatctcacaccctgaggaataaagattggaatccgcactggatgctggaagttgactcggagaaaattgcgacaggagggaaatggcggctctgcaaaagttgccacactgcagaaagctggtcctgctgtgcttccttttggcgaccctgtgggaggccagggccgggcagattcgctattctgtgcgggaagagatcgacagaggctccttcgtaggcaacatcgccaaggacttgggtttggagcccctggcactggcagagcagggagtccgcatcgtctccagaggtaggtcccagctctttgctctgaacccgcgaagcggcagcttggtcactgcgaacaggatagaccgggaggagctctgcgctcagagcgcaccctgtctgttgaattttaacattctgctggaggataaattgactatttattcagtagaggtggaaataacagatattaacgataatgcccctcgctttggagtagaggaactggagctaaaaatcagtgaaaccactacgccaggattccggattcctcttaagaatgcgcatgatgcagacgtaggtgagaacgcccttcagaagtacgcactcaacccaaatgaccacttctccctggacgtgcgaaggggagctgatgggaacaagtacccagaactggtgctggagcgctctctggaccgcgaggaagaggctgttcaccacctcgttctcgtggcttctgatgggggtgacccagtgctatctggcacctcccgcatctgcgtgaaggtcctggatgcgaacgacaatgcgcctgtttttacacagcccgagtaccgcataagcattccggagaatacgctcgtgggcacccggatactcacggtgaccgccactgacgcagatgagggctactacgctcaagtggtatattttctagagaaaagccctggagaaacctcagaggtatttgagcttaagtcaacatctggagaactgacaatcataaaagatctagattatgaggatgctacattccatgaaattgatattgaagctcaggatggtccgggccttctaaccagagcgaaggttatcgtcacggttctggatgtgaatgacaatgccccagaattttacatgacatctgctactagctcagtttctgaagactctcttccaggaaccataattgggctttttaatgtacatgatagagactctgggcagaacgcattcaccacctgttcactccccgaggatcttccttttaagttagaaaagtcagtagacaattactaccgactggttacaaccagagcccttgacagggaacagttttccttttacaacatcactctaaccgctaaagatggagggaacccctccctgtccacggatgctcacattttgctccaggtggcagacatcaacgacaacgcacccgccttctcccgcacatcctactccacctacattcccgaaaacaaccccagaggagcctctgtcttctcagtgacggcccatgaccccgacagcaacgacaatgctcatgtaacttactctttcgcggaggacactgttcagggggcacccttatcctcttacatctctatcaactccgacactggagtactctatgcactgcgctcctttgattatgagcagttgcgagacttgcaagtgtgggtgatagcgcgggacagcgggaaccctccactcagtagcaatgtatcattaagcctgttcgtgctggaccagaacgacaacgcgcccgagatcctgtaccctgccttccccacagacggttccactggcgtggagctggcgccccgctccgcagagcccggctacctggtgaccaaggtggtggcggtggacagagactcgggccagaacgcctggctgtcttaccacctgctcaaggccagcgagccgggactcttctcggtgggtctgcacacgggcgaggtgcgcacggcgcgagccctgctggacagagacgcgctcaagcagagcctcgtggtggccatccaggaccacggccagccccctctctccgccactgtcacgctcaccgtggccgtggccgacaggatccccgacatcctggccgacctgggcagcctcgagccctccgccatacccaacgattcggacctcactctgtacctggtggtggcggtggccgcggtctcctgcgtcttcctggccttcgtcatcgtgttgctggcgcacaggctgcggcgctggcacaagtcacgcctgctgcaggcttcaggaggcagcttgacaggcatgcagagctcgcactttgtgggcgtggacggggttcgggctttcctgcagacctattcccacgaggtctccctcactgcggactcgcggaagagccacctgattttcccccagcccaactatgcggacacgctcatcagccaggagagctgtgagaaaaaggattttttatcagcgcctcaatctctactcgaagaagaaagagaagaaacgttttctcaggtaatctatcttttcacaacatacgtactagctagtttgctgaagtaa

SEQ ID NO: 454972 - DNA, 2721 bp, Homo sapiens
atggcggctcagccgaggggcggggactacagaggattcttcctgctctccatcctcctggggaccccctgggaagcctgggcaggacgtattctctactccgtgtcggaggagacggacaaagggtcctttgtgggagacatcgccaaggacctggggctggagccccgggagctggcggagcgcggagtccgcatcatctccagaggtaggacgcagcttttcgccctgaaccagcgcagcggcagcttggtcactgcgggcaggatagaccgggaagagatctgcgctcagagtgcgcggtgtctggtaaactttaacatcctgatggaagataaaatgaatctttaccctatagacgtggaaataatagatattaatgacaacgttccaagattcttgacggaagaaataaatgtaaaaataatggagaatacagctcctggggttcggtttccgttaagcgaggctggggatccagatgtgggcacgaactccctccagagttaccagctcagccccaatcgccacttctccctggctgtgcaaagtggagacgatgaaactaagtacccggaactggtgctggagcgggtgctggaccgggaggaagagcgggttcaccacctggtcctcacagcctctgatggcggcgacccgccccgatccagcaccgcccacatccaggtgacagtggtggatgtgaatgaccacacgcctgtcttctctctgcctcagtaccaagtaactgtccccgagaatgtgccagtgggtacaagactgctcacggtacatgctatcgacctggacgagggagtcaatggggaagtgacatattcttttcggaaaataactcctaaacttccaaagatgtttcatctgaactcgcttacaggagaaatatcaactttagaaggattagattatgaagaaactgccttctatgaaatggaggttcaggctcaagatggtcctggtagtctgacaaaggcaaaagtactgatcacagttttagatgtaaatgataatgctccagaagtgactatgacgtctttaagtagctcaatccctgaagacacacctcttgggacagtcattgctcttttctacctacaagacagagattctggaaagaatggtgaggtgacctgcaccattccagaaaacctaccttttaaattagaaaaatcaatagataattattatagattggtcacaaccaaaaacttggaccgggaaacactctctttgtataacatcacactgaaagccacagatggtggaactcctcccttgtccagggaaactcacatattcatgcaggtggcagacaccaacgataacccacccaccttcccccactcatcctactcagtctacatcgctgagaacaaccccagaggggcctccattttcttagtgactgcacaggaccacgacagtgaggataatgcccagatcacttattccttggccgaagacaccatccagggggctccagtgtcctcctatgtctccataaactctgacactggagtcctgtacgcgctgcaatcctttgattatgagcagttgagagaactacaactaagagtgactgcacatgacagcggggacccgcctctcagcagcaacatgtcactgagcctgttcgtgctggaccagaatgacaacccgcccgagatcctgtacccggccctccccacagatggttctactggcatggagctggcaccccgctccgcagagcccggctacctggtgaccaaggtggtggcggtggacaaagattcaggccagaacgcctggctgtcatacctcctgcttaaggccagcgagccaggactctttgcggttgggctgtacacgggcgaggtgcgcacggctcgggccctgctggacagagatgccctcaagcagagcctcgtggtggccgtccaggaccacggtcagcctcctctgtcagccaccgtcacactcaccgtggctgtggctgacagcatccccgaagtcttggccgacctgggcagccttgagccctccgacggtccttacaactatgacctcacgttgtacctggtggtggcggtggccacagtctcctgcgtcttcctagccttcgtcctcgtactgctggcgctcaggctgcggcgctggcacaagtcacgcctgctgcaggcttcagaaggtggcttggcgaacgtgcccacctcgcactttgtgggcatggacggggtgcaggctttcctgcagacctattcccatgaggtctccctcaccgcggactctcggaagagtcacctgatcttcccccagcccaactatgtagacatgctcatcagccaggagagctgtgagaaaaatgattctttgctaacatccgtagattttcaggaatgtaaagaaaacctgccaagtattcaggtgagcccagcccttcctttatttccatgaggaatttatttgcatgatatttctctattattttgcaaaacaaatgttttgaaaatagggatttaaaaaactttatagaggtaaaaatgagtttaccagtttccttcagtggtgacactttaatatagaacacataggatatagtatttctttagtgaaagcctatggacaagattatgaatatgtggactatcacattttataatttccacctactttccaatctatgttccaacctactttcttaactcatatattttatacatt

SEQ ID NO: 454973 - DNA, 2608 bp, Homo sapiens
gctgcgcagacctttcccagcacagcggattgccagctccgagacccgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtgctatttcctttgctgctgcctttgttctaccccaccctgagtgagccgatccgctactcgattccggaggagctggccaagggctcggtggtggggaacctcgctaaggatctagggctcagtgtcctggatgtgtcggctcgcaagctgcgagtgagcgcggagaagctgcacttcagcgtagacgcggagagcggggacttacttgtgaagaaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaatttgataaaaaggaaatacatttagaaattttcgaatctgcatccgctggtacacgactatcgcttgaccctgccacggatcctgatataaacataaactcaattaaagattataagataaactctaatccttatttttcattaatggttagagttaattccgatggtggcaaatacccagagttatctctggagaaactcctagaccgggaagaacagagatctcatagcttgatattgactgccttggacggaggggacccaccaagaagtgccaccgctcacatagaaatttctgtcaaggataccaatgataaccccccggttttcagcagagacgaatatagaattagtcttagtgaaaatctgccccctgggtcccctgtgttgcaagtgacagccactgaccaggatgagggggtcaatgctgagataaactactacttccgaagcactgcccagagcacaaaacatatgttctcattggatgagaaaacaggtatgattaagaataaccagtcatttgattttgaagatgtagaaaggtacaccatggaagtggaagcgaaggacggaggtggtctctctacccagtgtaaagtaatcatagaaatccttgatgaaaacgacaacagcccagaaataatcatcacttctctctctgatcagattttggagaattcacctccaggaatggttgttgccctcttcaaaacacgggatctggatttcggaggaaatggagaagtcaggtgtaatatagaaacagacattccattcaagatttattcttcttccaataactactacaaactggtgacagatggagccctggaccgagagcagacaccagaatacaatgtcaccatcgtagccactgacaggggcaagccgcctctttcttccagtagaagcatcaccttgtatgtcgctgacatcaacgacaacgccccagttttcgaccagacgtcctacgtggtccacgtggccgagaacaacccgccaggagcctccattgcgcaagtgagcgcctctgacccggatttggggctcaatggccacatctcctactctatagtggcgagtgacctagagcccctggcggtgtcgtcatacgtgtcagtgagcgcgcagagcggggtggtgttcgcgcagcgcgcctttgatcacgagcagctgcgcgccttcgcgctcacgctgcaggcccgcgaccacggctcgcccacgctcagcgccaacgtgagcctgcgcgtgttggtgggagaccgcaatgacaacgcaccgcgggtgctgtacccagctctgggtcctgacggctccgcgttcttcgatatggtacctcgctctgcagagcccggctacctagtgactaaggtggtagcggtggacgccgactcgggacacaacgcctggctgtcctaccacgtgctgcaggccagtgagcccggactcttcagcctggggctgcgcactggggaggtgcgcacggctcgagccttaggcgacagggacgcagcccgccagcgcctgctggtcgctgtgcgtgacggtggacagccgccactctctgccaccgccacgcttcatctggtcttcgcagacaacttgcaagagatactgccagacctcagcgaccgccctgtactctctgacccccaggctgaactgcagttttacctggtggtggccttggccttaatctcagtgctcttcctcctcgccgtgattctggccattgccttgcgcctgcgacgctctctcagccctgctacttgggactgcttccatcctggtctctgtgtcaagtctggacctgtagttccccccaactacagtgaggggactttgccttattcttataatctgtgcattgcacatacgggtacaaaagagtttaatttcctaaaatgcagtgtgcccctacattccaatgaagacatggtttgcagtgtttctcctggagccttaattccacctcatggtggggaggatttgacttcacatcctgagactctgacttcggtgagtttctcttttttgtgtgtgatttatctaatagtctactag

SEQ ID NO: 454974 - DNA, 2490 bp, Homo sapiens
atgaccaattgcctgagtttccgaaatggcagaggactggccctgctgtgcgcgctcctggggacgctgtgcgaaacaggatccggtcagatccgctactcggtgtctgaggagctagataaaggttccttcgtgggcaacatcgctaacgacctggggctagagccccgggagctggcggagcgcggagtccgcatcgtctccagaggtaggacgcagcttttctctctgaatccgcaaagcggcagcttggtcaccgcggagaggatagaccgggaggagctctgcgctcagatcccgctgtgtctggtaaaaattaacattctggttgaggataaattgaaaatttttgaagtagaaatagaaattaaagatattaatgataatgctcctaatttcccaacagaggaattggaaataaaaattggtgaactaacggttcctggaacccgatttccaattaaaactgcttttgacccagatgtaggcattaactccctgcagaactacaagcttagccccaatgactacttctctctggctgtgaatagcgtctctgagggggccaagtatccagagctggtgctggagcgggccctggaccgtgagaaaaaagaaattcaccagcttgtcctggttgcctctgatggtggcgaccctgtccactctggcaacttgcacatccaagtgatagtcctggatgcaaatgacaacccaccaatgtttactcagcctgagtaccgtgtgagtgtttgggagaacgtgcctgtgggtacccggctgctcacggtgaatgccactgaccctgacgagggattcaatgctcaagtgtcttatattctagataaaatgcctgggaaaatcgctgagattttccatcttaactcagtgagtggagaagtatcaatattaaaaagtctagattatgaggatgccatgttctatgaaattaaaattgaagcacaggatggaccaggtcttctttcaagagccaagattctagtcacggttctggatgtgaatgacaatgctccagaaattacaatcacgtctctcacaagctcagtcccagaagagggcaccgttggaagagaaattgctcttatcgacgtgcatgaccgagattctgggcagaatgggcaggttgaagtttttgtcctgggaaatctgccatttaagttagaaaaatcaatagatcaatattaccgcttagtgacggccacatccctggaccgcgaacaaatatcagaatataacattagtctgagagcctcagatgggggaagcccgccactgtccacagaaactcacatcaccctgcatgtgattgacatcaatgacaacccacccaccttccctcatttatcctactccgcctacattccagaaaacaaccccagaggagcctccatcttctcagtgacagcccaggacccagatagcaacaacaacgcccgcatcacttatgcattgaccgaggacactctccagggggcgcccctgtcctccttcgtctctatcaactccaacactggcgtcctatacgcgctgagatccttcgactacgagcaatttagagacttaaagctactggtgacagccagcgacagcgggaaccctccactcagcagcaacgtgtcgctgaacctgttcgtgctggaccagaacgacaacgcgcccgagatcctgtaccccgccctccccacagacggttccactggcgtggagctggcgcctcgctccgcagagcccggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagacgcgctcaagcagagcctcgtggtggccgtccaggaccacggccagccccctctctccgccactgtcacgctcaccgtggccgtggccgacaggatccccgacatcctggccgacctgggcagcctcgagccctccgccaaacccaacgattcggacctcactctgtacctggtggtggcggtggccgcggtctcctgcgtcttcctggccttcgtcatcgtgctgctggcgctcaggctgcggcgctggcacaagtcacgcctgctgcaggcttcgggaggcggcttggcgagtacgcccggctcgcactttgtgggcgcggacggggttcgggctttcctgcagacctattcccacgaggtctccctcactgcggactcgcggaagagccacctgattttcccccagcccaactatgcggacacgctcatcagccaggagagctgtgagaaaagcgagcctcttctgataactcaggatttacttgaaatgaaaggagattccaacctacttcaggtgagtttatttatttctttgattattaagaacaaatatgagaatgtggttattataaagctttaa

SEQ ID NO: 454975 - DNA, 2457 bp, Homo sapiens
atggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacaagatttatactagaagtagcagaagatgcagatattggcttaaactctctgcagaagtataaactctctcttaacccaagtttctcattaataattaaggagaaacaggatggtagtaaatacccggaactggcactggagaaaaccttagaccgggaacaacagagttaccatcgtttagtcctgactgccttggacggtggacatccacccctaagcggcaccactgagctccggatccaggtaaccgacgccaatgataatcccccggtattcaaccgagacgtgtacagagtcagccttcgggaaaacgtgccaccaggcaccactgtgttgcaagtgtcagccactgaccaagacgagggcatcaactcagaaattacttattccttctacagaaccgggcaaatctttagtctgaattcaaagagcggagaaattaccactcaaaagaaactggattttgaagagaccaaggaatattcaatggttgtagaagggagggatggtggtggactggttgcacaatgtacagttgaaattaatattcaagatgaaaatgacaatagcccagaagttacattccattctctacttgaaatgattctggaaaacgcggtgcctggaacactaattgctttgatcaaaatacatgaccaagattctggggaaaatggggaggttaattgtcaattacaaggcgaagtcccttttaagattatctcttcatccaaaaattcgtataagttggtaacagatggaaccctagaccgagagcaaaccccggagtacaatgtcaccatcacagccacagacaggggcaagccgcccctctcctccagcataagcgtcatcctacatatcagagacgtcaacgataacgctccggttttccaccaggcgtcctacttagtcagtgtacccgaaaacaaccctcctggggcctccatcgcgcaagtctgcgcctcggacctggacttggggttgaacggccaagtctcctactctatcatggccagcgacctagagcctctggcactggcctcttacgtgtccatgagcgcgcaaagtggggtggtgttcgcgcagcgcgcctttgactacgagcagctgcgcaccttcgaactcacactacaggcccgcgaccagggctcgcctgcgctcagcgcaaacgtgagcctgcgcgtgttggtgggcgaccgaaacgacaacgcaccgcgggtgctgtaccccgcgctgggtcccgacggctctgcgctcttcgatatggtgccgcgcgctgcagagcccggctacctggtgaccaaggtagtggccgtggacgcagactcaggacacaacgcctggctgtcctaccacgtgctgcaggctagcgagcccgggctcttcagcctggggctgcgcacaggagaggtgcgcacagcgcgtgccttgggcgacagggacgcggcccgccagcgcctgctggttgctgtgcgtgatggtggacagccgccactctccgccaccgccacgctgcacttggtctttgctgacagcttgcaggaggtgctgccggatatcactgaccgccctgtaccctctgacccccaggctgagctgcagttttacctagtggtggccttggccttgatctcagtgctcttcctcctggccgtgattctggccgttgccttgcgcctgcgacgctcctccagccctgccgcctggagctgcttccaacctggtctctgtgtcaagtctggacctgtggttccccccaactacagtcaggggactttgccttattcctacaacctatgtgttgcacatacaggaaagacggagtttaatttcctaaaatgtagtgagcaattgagttcaggacaagacatactttgtggtgattcatctggggccttatttccactttgtaattccagcgagtcgacttcccatcctgagttggtgagtttcatttatgtctattctttttcattacccacccaattttctgtatttacatga

SEQ ID NO: 454976 - DNA, 2445 bp, Homo sapiens
atgggaaatagctccggatggaggggcccagcagggcagaggcgaatgctatttctcttcctgctctctttgttagaccaggttctctccgaaccgatccgctacgctattcccgaggagctggacaggggctcgctggtagggaacctcgccaaggacctggggtttggcgtgggggatttacctactaggaacctgcgggttattgcagagaagaaattctttaccgtgagccccgaaaatgggaacttacttgtgagcgaccgtatagaccgagaggagatttgtggcaagaagtcgacgtgtgttctggaatttgaaatggttgctgaaaagcctttaaacttttttcatgtaactgtgctgatccaggatattaacgacaacccaccgacctttagccaaaatatcactgagctggaaatcagcgaactggctctcactggagccacatttgccctggaatctgcgcaagatcctgatgtaggtgtcaattcgctgcagcagtactacctcagccctgatccgcacttctctttgattcagaaggagaacctggatggcagtaggtacccagagctagtactgaaagcacccctggacagggaagagcagccacatcaccacctggtcctcacagctgtggatgggggcgagccctccagaagctgtaccacccagatcagggtaattgtcgcagatgcaaatgataaccccccagtatttactcaggacatgtacagggtcaatgttgcagagaacctgcccgctggctcctccgtattaaaagtgatggccattgacatggatgagggcatcaatgccgaaatcatctatgccttcatcaatattggcaaggaagtgagacaactgttcaagctggacagtaaaacgggggaactcaccactattggagaactggactttgaagagagagatagctacacaattggggtggaagcaaaggatggtggacatcacactgcatattgtaaagtacagatagatatttcagatgaaaatgacaatgccccggagataaccctggcttctgaatcccaacatatacaagaagatgctgagctggggactgccgttgccctgatcaaaacacatgatctagattctggatttaatggagaaatcctatgccaactaaaaggaaacttcccctttaaaatcgttcaagataccaaaaacacatacaggttggtgacagatggagccctggaccgggagcagatcccagaatacaatgtgacgatcacagctaccgacaaaggcaatccaccgctctcctccagcaagaccatcactctgcacatccttgatgtcaacgacaacgttcccgttttccaccaggcctcctacaccgtgcatgtagctgagaacaatccgcctggagcctccattgcgcatgtcagagcctcggatcccgacttgggacctaatggccttgtctcctactacatcgtggccagtgacctggagccgcgggagctgtcgtcctacgtgtccgtgagcgcgcggagcggggtggtgttcgcgcagcgagccttcgaccacgagcagctgcgtgccttcgagctcactctgcaggcccgcgaccagggctcgcctacgctcagcgccaacgtgagcctgcgcgtgttggtggacgaccgcaacgacaatgcaccgctggtgctgtacccagctctggggcccgaaggctctgcgctcttcgatatggtgccgcgctctgcagagcctggctacctggtgaccaaggtggtggcggtggacgcagactcgggatacaacgcctggctgtcctaccacattgtgcaggccagcgagcccgggctgttcagcctgggcctgcgcacgggtgaggtgcgcacggcgcgtaccttgggcgacagggaggccgcccgccagcgcctgctggtcactgtgcgtgatggaggacagcagcctctttcagccaccgtcatgctgcacctaatcttcgcagatagcttgcaagagatacaacctgaccttagcgaccgccccactccctctgaccctcaggcggagctacagtttcacctagtagtggcgttggccttgatctcagtgctcttcctcctcgcggtgattctggcaatctccctgcgcctgcgatgctcctccagacccgccactgagggctactttcagcctggtgtctgcttcaagactgtacctggagttctccccacctacagcgaaaggactttgccttattcctacaatccgtgtgctgcctcacattcctcaaacaccgagtttaaatttctcaatataaaggctgaaaatgctgcaccacaagatcttctatgtgatgaagcctcttggtttgaaagtaatgacaatccagaaatgccttctaattcaggcaatttgcaaaaggtgagtttcttcaaacctttccttccataa

SEQ ID NO: 454977 - DNA, 9738 bp, Homo sapiens
cagggcagccccagctcagactccccagcgccagcctttacaccgcttcctcctcggaaaaagaagaattttttcttgaactggaactgcaactaaagtccgttcggagatccaaaaatctgcaatacagaggttatttgtaacccggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacacgatttatattaggatctgcccatgatgcggatattggtagcaacacactgcagaattaccaactcagtcccagtgatcatttctcactgataaataaagagaaatcagatggcagtaaataccctgagatggtattgaagacacctttggacagagaaaagcagaaatcctaccacttgactttgactgccttggactttggagctccacccctaagcagcactgcacagatacacgttctagtgactgatgccaatgataatgctccagtgttcagtcaagacgtatacagggtgagcctttcagaaaacgtgtacccggggaccacggtgctacaggtgactgccacggaccaggatgagggtgtcaatgccgagattactttctctttcagtgaagctagccagatcacccaatttgacctgaactctaacaccggggaaattactgttttaaatacattagattttgaagaagtcaaagaatattccatagttttggaagcaagggacggtggaggaatgattgcgcaatgcacagtggaggtagaagtcatagatgaaaatgacaacgccccagaagtgatattccagtctctacccaacctaattatggaggacgccgagctgggaacacatattgctttgctcaaagtccgtgacaaggattccagacacaatggagaagtgacttgtaaattggaaggtgatgttccatttaaaatattaacttcttcaagaaacacgtataaattagtgacagatgctgttctagaccgcgagcagaatccagagtacaatataaccgttacggcaacagatcggggcaagcctcccctctcctccagttccagcatcaccctgcacattggtgatgtaaatgacaacgctccggttttctcacagtcttcctatatagtccacgtggccgagaacaacccgcctggagcctctatttcacaagtcagggcttctgatccggacttggggcccaacggccaagtctcttactgcatcatggccagtgacctggagcagcgggagctgtcatcctacgtgtccataagcgcggagagcggggtggtgttcgcgcagcgcgccttcgaccacgagcagctgcgcgccttcgaactcacactgcaggcccgcgaccagggctcgccagcgctcagcgcgaacgtgagcctgcgcgtgttagtggacgaccgcaacgacaatgcgccacgggtgctgtaccccgcgctgggtcccgacggctctgcgctcttcgatatggtgccgcacgctgcagagcctggctacttggtgaccaaggtagtggcggtggacgcagactcaggacacaacgcctggctgtcctaccacgtgctgcaggctagcgagcccgggctcttcagcctggggctgcgcacgggcgaagtgcgcacagcgcgtgccttaggcgacagggacgccgtccgccagcgccttctggtcgccgtgcgtgacggtggacagccaccactctcggccactgccacgttgcacctggtcttcgccgacagcttgcaggaggtgctgccggatatcactgaccgccccgacccctctgacctccaggctgagctgcagttttacctagtggtggccttggccttgatctcagtgctcttcctcgtggccatgattctggccattgccttgcgcctgcgacgctcctccagccccgcctcctggagctgcttccagcctggtctctgtgttaaatccgaatccgtggttccccccaactacagcgaggggactttgccttattcctacaatctatgtgttgcacatacaggaaagacggagtttaatttcctaaaatgtagtgagcagttgagttcaggacaagacatactttgcggtgattcatctggggccttatttccactttgtaattccagtgaattgacttcccatcaggtgagtttcctttaagtataatttaatgctcattgcctacccatttctccatattcacaagaaaatatacatatttgcaggaaaatatataatttttagatgtcatggatcattttaggaaagttgtagtcagttaaaaagctgtcatatcattctacaaaggaggagtaaagtaggagcaattgtgtggcccaacatttgtttgttttttagccaagcttagatttataaagcaatgagggtgtggttttaaccacaaagtgaaagtgttagacagttgttggctctctcctaaaaagtgaatgagatttttcctatacattttccttcttgttgactaatatatgatgaatacttttttcagcttggatataccataaatataaaaataataaagccaaagaatttaagctaaaattcaacacttttcttaactaatttaactggtatggtctccatagtagtccactgttttgtttcctgtgttaacttcccttttgtttcaaaagctcttagaataaggagtcaactggatttttatgtccatggaccccttgtgattatatgcagtgtacgctgtgtgtgcgtgtgtgtgtgtgtgtgtgtgagagagatccttttacttagaaaaaggtctactatgctcattagaagatcaaaagcagattctccttacttgtaacataggagtttcaggattaatctgtattcaagctcattctatatccttcatcaaagaaaagacaatgttttgtgtctgttgtccctctcacacacagccctaatatataatgtgtaactgccttatctgcagccctaaactaatatagctagaggtcttctaatcattctcctacctctaggaaagaaatatagtcttgaaaactgccaatctggtgtgcatacaaaatatatacaaaataccaaggaacattatatgagccttttgctaggtatatctaagcaactgcttcagttaatggccactttacaaattgctgaaagaaggaaacgtctttcgattcttttttttttctttttttttttttgagacagagtctctgtctgttactcaggctgtagtgcagtggcacaatgatagctccctccagcctcaaactcctgggctcaagcattccttctgcatcagcctcctgactagctggaactcaggctcatgccaccagacctggctaatttttctgttttcagtagagaaaatattttctttcactaatttaactggtatggtttccattgtctacccagttttccatatgcataagaaaatatattcacaggaaaatataaagttttcagatttcatgagtggttttaagaaagttttagtcagtgaaaaaactatcataccagtcttcaaaggaagggtgaaataagttcatctgctacgttgcccaggctggtcttgaagggaaacagacttttttgtagtcatacttatcctttggcttcttagtaagtattatatagtcattactttttgcagttttttagatcaaagtgttaatgtaggtaaagttaattttagaatatatgtaaaagtcaagtctgctttaaatttaatcatctctttggtgaaagggatgggatggagctttgctttttatcatatattcatctgtacctttcaagtattcaaatagaaaaatataaacaatgtaaataaaatagcaaaacaatgtaatatctcataaaactgcaatggtaaaagcatttatcctattgaaattccacaatttttatttgaaaatattatcgacatgtaattcaagtggcatttagaagaataatttaaaagcaacaactctatagaaagcttgtaaaatgattaagtagtttaaaccaaataaaacaatttctgagtcagtcatctccagtaggtctattttagtctcaagataaattcatttctggtgacaactgaagttcttagttatttgttagtatatattggagacatttacaataaagcttagagcacaatgggaaatgaaagtatcatgttttttttaagaccaaatgtattgcagaaatgtgagtaatttaatccgatgctacaatctgatcattctgatctaatctgatcatttaataacactaaataaaaccttcatctcacattctttggctgtttcttttaaaatatgggtttacggataaatcaaataaattcaaaacaaagtaataagcaaatgatttttttttctcagtaatctagtagagtattacatttagaagtaatctgtatctcagtgcagtaactatttaggactgtaagcgccgctgttcacctactggaagacaaatgcaaccgaaaacactcagatctcacacctcacgaagacccgcagatgccacaaactaactgctggactgcagcgaaacccgacccctgtttggaggcactccaggtttccggaggattgtcatctccatagctgcggcaagaaactaaataagacccatttatgcacagtgaagattctgagaggattctgcagcaaaacaacaatggccgctccacagagtcgccccagacgcggcgagctgatcctgctgtgcgcgctgctgggaacgctgtgggaaatcgggaggggacagattcgctactctgtgccagaagagacggacaaaggctccttcgtgggtaatatctccaaggacctggggctggacccccggaagctggcgaagcacggagtccgtatcgtctccagaggtaggacgcagctctttgctctgaacccgcgcagcggcagcttgatcaccgcgggcaggatagatcgggaggagctctgcgctcagagcccgcggtgtctgataaatattaacaccctggttgaggataaaggaaaactctttggggtagaaatagaaataattgatattaacgataataacccaaaattccaggtcgaagatctagaagtaaaaattaacgaaatcgcggttcctggagcacgttatccactcccagaagctgttgacccggatgtgggcgtgaactccctccagagctaccagctcagccccaatcaccacttctccctggacgtgcagactggagacaatggagccataaacccagagctggtgctggagcgcgccctggacagggaggaagaggctgctcaccacctggtcctcacggcctcggatggcggcaagccgcctcgctctagcacagtgcgcatccacgtgacagtgttggatacaaatgacaatgccccggtttttcctcacccgatttaccgagtgaaagtccttgagaacatgcccccaggcacgcggctgcttactgtaacagccagcgacccggatgagggaatcaacggaaaagtggcatacaaattccggaaaattaatgaaaaacaaactccgttattccagcttaatgaaaatactggggaaatatcaatagcaaaaagtctagattatgaagaatgttcattttatgaaatggaaatacaagccgaagatgtgggggcacttctggggaggaccaaattgctcatttcggtggaagatgtaaatgacaatagaccagaagtgatcattacgtctttgtttagcccagtgttagaaaattctcttcccgggacagtaattgccttcttgagtgtgcatgaccaagactctggaaagaatggtcaagttgtctgttacacacgtgataatttaccttttaaattagaaaagtcaataggtaattattatagattagtgacaaggaaatatttggaccgagaaaatgtctctatctacaatatcacagtgatggcctcagatctaggaacaccacctctgtccactgaaactcaaatcgctctgcacgtggcagacattaacgacaaccctcctactttccctcatgcctcctactcagcgtatatcctagagaacaacctgagaggagcctccatcttttccttgactgcacacgaccccgacagccaggagaatgcccaggtcacttactctgtgaccgaggacacgctgcagggggcgcccctgtcctcgtatatctccatcaactctgacaccggtgtcctgtatgcgctgcaatctttcgactatgagcagatccgagacctgcagctactggtaacagccagcgacagcggggacccgcccctcagcagcaacatgtcactgagcctgttcgtgctggaccagaatgacaacgcgcccgagatcctgtaccccgccctccccacagacggttccactggcgtggagctggcgccccgctccgcagagcgtggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagatgcgctcaagcagagcctcgtggtggccgtccaggaccatggccagccccctctctccgccactgtcacgctcaccgtagccgtggctgacagcatccccgaagtcctgaccgagttgggcagtctgaagccttcggtcgacccgaacgattcgagccttacactctatctcgtggtggcagtggctgccatctcctgtgtcttcctcgcctttgtcgctgtgcttctggggctcaggctgaggcgctggcacaagtcacgcctgctccaggattccggtggcagattggtaggcgtgcctgcctcacattttgtgggtgttgaggaggtacaggctttcctgcagacctattcccaggaagtctccctcaccgccgactcgcggaagagtcacctgatctttccccagcccaactacgcagacatgctcatcagtcaggagggctgtgagaaaaatgattctttgttaacatccgtagattttcatgaatataagaatgaagctgatcatggtcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctaaacgtttctgtataag

SEQ ID NO: 454978 - DNA, 4496 bp, Homo sapiens
atgaccaattgcctgagtttccgaaatggcagaggactggccctgctgtgcgcgctcctggggacgctgtgcgaaacaggatccggtcagatccgctactcggtgtctgaggagctagataaaggttccttcgtgggcaacatcgctaacgacctggggctagagccccgggagctggcggagcgcggagtccgcatcgtctccagaggtaggacgcagcttttctctctgaatccgcaaagcggcagcttggtcaccgcggagaggatagaccgggaggagctctgcgctcagatcccgctgtgtctgaggaattggaaataaaaattggtgaactaacggttcctggaacccgatttccaattaaaactgcttttgacccagatgtaggcattaactccctgcagaactacaagcttagccccaatgactacttctctctggctgtgaatagcgtctctgagggggccaagtatccagagctggtgctggagcgggccctggaccgtgagaaaaaagaaattcaccagcttgtcctggttgcctctgatggtggcgaccctgtccactctggcaacttgcacatccaagtgatagtcctggatgcaaatgacaacccaccaatgtttactcagcctgagtaccgtgtgagtgtttgggagaacgtgcctgtgggtacccggctgctcacggtgaatgccactgaccctgacgagggattcaatgctcaagtgtcttatattctagataaaatgcctgggaaaatcgctgagattttccatcttaactcagtgagtggagaagtatcaatattaaaaagtctagattatgaggatgccatgttctatgaaattaaaattgaagcacaggatggaccaggtcttctttcaagagccaagattctagtcacggttctggatgtgaatgacaatgctccagaaattacaatcacgtctctcacaagctcagtcccagaagagggcaccgttggaagagaaattgctcttatcgacgtgcatgaccgagattctgggcagaatgggcaggttgaagtttttgtcctgggaaatctgccatttaagttagaaaaatcaatagatcaatattaccgcttagtgacggccacatccctggaccgcgaacaaatatcagaatataacattagtctgagagcctcagatgggggaagcccgccactgtccacagaaactcacatcaccctgcatgtgattgacatcaatgacaacccacccaccttccctcatttatcctactccgcctacattccagaaaacaaccccagaggagcctccatcttctcagtgacagcccaggacccagatagcaacaacaacgcccgcatcacttatgcattgaccgaggacactctccagggggcgcccctgtcctccttcgtctctatcaactccaacactggcgtcctatacgcgctgagatccttcgactacgagcaatttagagacttaaagctactggtgacagccagcgacagcgggaaccctccactcagcagcaacgtgtcgctgaacctgttcgtgctggaccagaacgacaacgcgcccgagatcctgtaccccgccctccccacagacggttccactggcgtggagctggcgcctcgctccgcagagcccggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagacgcgctcaagcagagcctcgtggtggccgtccaggaccacggccagccccctctctccgccactgtcacgctcaccgtggccgtggccgacaggatccccgacatcctggccgacctgggcagcctcgagccctccgccaaacccaacgattcggacctcactctgtacctggtggtggcggtggccgcggtctcctgcgtcttcctggccttcgtcatcgtgctgctggcgctcaggctgcggcgctggcacaagtcacgcctgctgcaggcttcgggaggcggcttggcgagtacgcccggctcgcactttgtgggcgcggacggggttcgggctttcctgcagacctattcccacgaggtctccctcactgcggactcgcggaagagccacctgattttcccccagcccaactatgcggacacgctcatcagccaggagagctgtgagaaaagcgagcctcttctgataactcaggatttacttgaaatgaaaggagattccaacctactcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454979 - DNA, 2925 bp, Homo sapiens
attggctgggactctgtgtgccgctgtcggccaatgaagacgctggagatcgggcccctgcccgtcccctttctgcgccccgggatgaggcagagactgaacagccggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagttcccctctggctctgccccccgggagcagaaaaaaaatctcaccttttatctacttctttctctaatcctggtttctgtggggtttgtggtcacagtgttcggagtaatcatattcaaagtttacaagtggaagcagtctagagacctataccgagccccggtgagctcactgtaccgaacaccagggccctccttgcacgcggacgccgtgcggggaggcctgatgtcgccgcacctttaccatcaggtgtatctcaccacggactcccgccgcagcgacccgctgctgaagaaacctggtgcagccagtccactggccagccgccagaacacgctgcggagctgtgatccggtgttctataggcaggtgttgggtgcagagagcgcccctcccggacagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454980 - DNA, 2287 bp, Homo sapiens
gcggggaaagggagataggtgtctccagctgctgtggctgtttggggcgggtcggcttcatccgcgtctcaggagcaagtagagaattagcgggcggcagcaatgctccgcaagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454981 - DNA, 10189 bp, Homo sapiens
cagggcagccccagctcagactccccagcgccagcctttacaccgcttcctcctcggaaaaagaagaattttttcttgaactggaactgcaactaaagtccgttcggagatccaaaaatctgcaatacagaggttatttgtaacccggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacacgatttatattaggatctgcccatgatgcggatattggtagcaacacactgcagaattaccaactcagtcccagtgatcatttctcactgataaataaagagaaatcagatggcagtaaataccctgagatggtattgaagacacctttggacagagaaaagcagaaatcctaccacttgactttgactgccttggactttggagctccacccctaagcagcactgcacagatacacgttctagtgactgatgccaatgataatgctccagtgttcagtcaagacgtatacagggtgagcctttcagaaaacgtgtacccggggaccacggtgctacaggtgactgccacggaccaggatgagggtgtcaatgccgagattactttctctttcagtgaagctagccagatcacccaatttgacctgaactctaacaccggggaaattactgttttaaatacattagattttgaagaagtcaaagaatattccatagttttggaagcaagggacggtggaggaatgattgcgcaatgcacagtggaggtagaagtcatagatgaaaatgacaacgccccagaagtgatattccagtctctacccaacctaattatggaggacgccgagctgggaacacatattgctttgctcaaagtccgtgacaaggattccagacacaatggagaagtgacttgtaaattggaaggtgatgttccatttaaaatattaacttcttcaagaaacacgtataaattagtgacagatgctgttctagaccgcgagcagaatccagagtacaatataaccgttacggcaacagatcggggcaagcctcccctctcctccagttccagcatcaccctgcacattggtgatgtaaatgacaacgctccggttttctcacagtcttcctatatagtccacgtggccgagaacaacccgcctggagcctctatttcacaagtcagggcttctgatccggacttggggcccaacggccaagtctcttactgcatcatggccagtgacctggagcagcgggagctgtcatcctacgtgtccataagcgcggagagcggggtggtgttcgcgcagcgcgccttcgaccacgagcagctgcgcgccttcgaactcacactgcaggcccgcgaccagggctcgccagcgctcagcgcgaacgtgagcctgcgcgtgttagtggacgaccgcaacgacaatgcgccacgggtgctgtaccccgcgctgggtcccgacggctctgcgctcttcgatatggtgccgcacgctgcagagcctggctacttggtgaccaaggtagtggcggtggacgcagactcaggacacaacgcctggctgtcctaccacgtgctgcaggctagcgagcccgggctcttcagcctggggctgcgcacgggcgaagtgcgcacagcgcgtgccttaggcgacagggacgccgtccgccagcgccttctggtcgccgtgcgtgacggtggacagccaccactctcggccactgccacgttgcacctggtcttcgccgacagcttgcaggaggtgctgccggatatcactgaccgccccgacccctctgacctccaggctgagctgcagttttacctagtggtggccttggccttgatctcagtgctcttcctcgtggccatgattctggccattgccttgcgcctgcgacgctcctccagccccgcctcctggagctgcttccagcctggtctctgtgttaaatccgaatccgtggttccccccaactacagcgaggggactttgccttattcctacaatctatgtgttgcacatacaggaaagacggagtttaatttcctaaaatgtagtgagcagttgagttcaggacaagacatactttgcggtgattcatctggggccttatttccactttgtaattccagtgaattgacttcccatcaggtgagtttcctttaagtataatttaatgctcattgcctacccatttctccatattcacaagaaaatatacatatttgcaggaaaatatataatttttagatgtcatggatcattttaggaaagttgtagtcagttaaaaagctgtcatatcattctacaaaggaggagtaaagtaggagcaattgtgtggcccaacatttgtttgttttttagccaagcttagatttataaagcaatgagggtgtggttttaaccacaaagtgaaagtgttagacagttgttggctctctcctaaaaagtgaatgagatttttcctatacattttccttcttgttgactaatatatgatgaatacttttttcagcttggatataccataaatataaaaataataaagccaaagaatttaagctaaaattcaacacttttcttaactaatttaactggtatggtctccatagtagtccactgttttgtttcctgtgttaacttcccttttgtttcaaaagctcttagaataaggagtcaactggatttttatgtccatggaccccttgtgattatatgcagtgtacgctgtgtgtgcgtgtgtgtgtgtgtgtgtgtgagagagatccttttacttagaaaaaggtctactatgctcattagaagatcaaaagcagattctccttacttgtaacataggagtttcaggattaatctgtattcaagctcattctatatccttcatcaaagaaaagacaatgttttgtgtctgttgtccctctcacacacagccctaatatataatgtgtaactgccttatctgcagccctaaactaatatagctagaggtcttctaatcattctcctacctctaggaaagaaatatagtcttgaaaactgccaatctggtgtgcatacaaaatatatacaaaataccaaggaacattatatgagccttttgctaggtatatctaagcaactgcttcagttaatggccactttacaaattgctgaaagaaggaaacgtctttcgattcttttttttttctttttttttttttgagacagagtctctgtctgttactcaggctgtagtgcagtggcacaatgatagctccctccagcctcaaactcctgggctcaagcattccttctgcatcagcctcctgactagctggaactcaggctcatgccaccagacctggctaatttttctgttttcagtagagaaaatattttctttcactaatttaactggtatggtttccattgtctacccagttttccatatgcataagaaaatatattcacaggaaaatataaagttttcagatttcatgagtggttttaagaaagttttagtcagtgaaaaaactatcataccagtcttcaaaggaagggtgaaataagttcatctgctacgttgcccaggctggtcttgaagggaaacagacttttttgtagtcatacttatcctttggcttcttagtaagtattatatagtcattactttttgcagttttttagatcaaagtgttaatgtaggtaaagttaattttagaatatatgtaaaagtcaagtctgctttaaatttaatcatctctttggtgaaagggatgggatggagctttgctttttatcatatattcatctgtacctttcaagtattcaaatagaaaaatataaacaatgtaaataaaatagcaaaacaatgtaatatctcataaaactgcaatggtaaaagcatttatcctattgaaattccacaatttttatttgaaaatattatcgacatgtaattcaagtggcatttagaagaataatttaaaagcaacaactctatagaaagcttgtaaaatgattaagtagtttaaaccaaataaaacaatttctgagtcagtcatctccagtaggtctattttagtctcaagataaattcatttctggtgacaactgaagttcttagttatttgttagtatatattggagacatttacaataaagcttagagcacaatgggaaatgaaagtatcatgttttttttaagaccaaatgtattgcagaaatgtgagtaatttaatccgatgctacaatctgatcattctgatctaatctgatcatttaataacactaaataaaaccttcatctcacattctttggctgtttcttttaaaatatgggtttacggataaatcaaataaattcaaaacaaagtaataagcaaatgatttttttttctcagtaatctagtagagtattacatttagaagtaatctgtatctcagtgcagtaactatttaggactgtaagcgccgctgttcacctactggaagacaaatgcaaccgaaaacactcagatctcacacctcacgaagacccgcagatgccacaaactaactgctggactgcagcgaaacccgacccctgtttggaggcactccaggtttccggaggattgtcatctccatagctgcggcaagaaactaaataagacccatttatgcacagtgaagattctgagaggattctgcagcaaaacaacaatggccgctccacagagtcgccccagacgcggcgagctgatcctgctgtgcgcgctgctgggaacgctgtgggaaatcgggaggggacagattcgctactctgtgccagaagagacggacaaaggctccttcgtgggtaatatctccaaggacctggggctggacccccggaagctggcgaagcacggagtccgtatcgtctccagaggtaggacgcagctctttgctctgaacccgcgcagcggcagcttgatcaccgcgggcaggatagatcgggaggagctctgcgctcagagcccgcggtgtctgataaatattaacaccctggttgaggataaaggaaaactctttggggtagaaatagaaataattgatattaacgataataacccaaaattccaggtcgaagatctagaagtaaaaattaacgaaatcgcggttcctggagcacgttatccactcccagaagctgttgacccggatgtgggcgtgaactccctccagagctaccagctcagccccaatcaccacttctccctggacgtgcagactggagacaatggagccataaacccagagctggtgctggagcgcgccctggacagggaggaagaggctgctcaccacctggtcctcacggcctcggatggcggcaagccgcctcgctctagcacagtgcgcatccacgtgacagtgttggatacaaatgacaatgccccggtttttcctcacccgatttaccgagtgaaagtccttgagaacatgcccccaggcacgcggctgcttactgtaacagccagcgacccggatgagggaatcaacggaaaagtggcatacaaattccggaaaattaatgaaaaacaaactccgttattccagcttaatgaaaatactggggaaatatcaatagcaaaaagtctagattatgaagaatgttcattttatgaaatggaaatacaagccgaagatgtgggggcacttctggggaggaccaaattgctcatttcggtggaagatgtaaatgacaatagaccagaagtgatcattacgtctttgtttagcccagtgttagaaaattctcttcccgggacagtaattgccttcttgagtgtgcatgaccaagactctggaaagaatggtcaagttgtctgttacacacgtgataatttaccttttaaattagaaaagtcaataggtaattattatagattagtgacaaggaaatatttggaccgagaaaatgtctctatctacaatatcacagtgatggcctcagatctaggaacaccacctctgtccactgaaactcaaatcgctctgcacgtggcagacattaacgacaaccctcctactttccctcatgcctcctactcagcgtatatcctagagaacaacctgagaggagcctccatcttttccttgactgcacacgaccccgacagccaggagaatgcccaggtcacttactctgtgaccgaggacacgctgcagggggcgcccctgtcctcgtatatctccatcaactctgacaccggtgtcctgtatgcgctgcaatctttcgactatgagcagatccgagacctgcagctactggtaacagccagcgacagcggggacccgcccctcagcagcaacatgtcactgagcctgttcgtgctggaccagaatgacaacgcgcccgagatcctgtaccccgccctccccacagacggttccactggcgtggagctggcgccccgctccgcagagcgtggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagatgcgctcaagcagagcctcgtggtggccgtccaggaccatggccagccccctctctccgccactgtcacgctcaccgtagccgtggctgacagcatccccgaagtcctgaccgagttgggcagtctgaagccttcggtcgacccgaacgattcgagccttacactctatctcgtggtggcagtggctgccatctcctgtgtcttcctcgcctttgtcgctgtgcttctggggctcaggctgaggcgctggcacaagtcacgcctgctccaggattccggtggcagattggtaggcgtgcctgcctcacattttgtgggtgttgaggaggtacaggctttcctgcagacctattcccaggaagtctccctcaccgccgactcgcggaagagtcacctgatctttccccagcccaactacgcagacatgctcatcagtcaggagggctgtgagaaaaatgattctttgttaacatccgtagattttcatgaatataagaatgaagctgatcatggtcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaaaaaaaagaaagaaagacaaaaaaaaaggggggggggaaagaaagaaaacagagagggggcacaacgacacgaccaggagaccacaggcgtactatagacacaaaaggtggacaccctaagagagagcagaagcaaataatccacagaccaaacgcatgaggccagcagcgtataacacaaagcagaagaacgaggacgaaccaacgagaacacaggggaaaacatcgtgggtgaagcgacacctacactccgctgggagcgagaccaacaccaaccggggcacaaaaccacccccgcagcagacaaaacaaacagagccgcacgagagcgacaccactgaacaagctgcagaagtgtcagacaagagcgccacaacagacaccggcgacaaaaggcacgcgacagcaaaacgactgacgagcaagcggacgccgaacatcggacaatcaacgacacggcgaccacccgaac

SEQ ID NO: 454982 - DNA, 2922 bp, Homo sapiens
  misc_feature (2922)..(2922): n is a, c, g, or t
attggctgggactctgtgtgccgctgtcggccaatgaagacgctggagatcgggcccctgcccgtcccctttctgcgccccgggatgaggcagagactgaacagccggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattgcaaagtgttggtggaggttgtggatgtgaatgacaacgccccggagatcacagtcacctccgtgtacagcccagtacccgaggatgcccctctggggactgtcatcgctttgctcagtgtgactgacctggatgctggcgagaacgggctggtgacctgcgaagttccaccgggtctccctttcagccttacttcttccctcaagaattacttcactttgaaaaccagtgcagacctggatcgggagactgtgccagaatacaacctcagcatcaccgcccgagacgccggaaccccttccctctcagcccttacaatagtgcgtgttcaagtgtccgacatcaatgacaaccctccacaatcttctcaatcttcctacgacgtttacattgaagaaaacaacctccccggggctccaatactaaacctaagtgtctgggaccccgacgccccgcagaatgctcggctttctttctttctcttggagcaaggagctgaaaccgggctagtgggtcgctatttcacaataaatcgtgacaatggcatagtgtcatccttagtgcccctagactatgaggatcggcgggaatttgaattaacagctcatatcagcgatgggggcaccccggtcctagccaccaacatcagcgtgaacatatttgtcactgatcgcaatgacaatgccccccaggtcctatatcctcggccaggtgggagctcggtggagatgctgcctcgaggtacctcagctggccacctagtgtcacgggtggtaggctgggacgcggatgcagggcacaatgcctggctctcctacagtctcttgggatcccctaaccagagcctttttgccatagggctgcacactggtcaaatcagtactgcccgtccagtccaagacacagattcacccaggcagactctcacggtcttgatcaaagacaatggggagccttcgctctccaccactgctaccctcactgtgtcagtaaccgaggactctcctgaagcccgagccgagttcccctctggctctgccccccgggagcagaaaaaaaatctcaccttttatctacttctttctctaatcctggtttctgtggggtttgtggtcacagtgttcggagtaatcatattcaaagtttacaagtggaagcagtctagagacctataccgagccccggtgagctcactgtaccgaacaccagggccctccttgcacgcggacgccgtgcggggaggcctgatgtcgccgcacctttaccatcaggtgtatctcaccacggactcccgccgcagcgacccgctgctgaagaaacctggtgcagccagtccactggccagccgccagaacacgctgcggagctgtgatccggtgttctataggcaggtgttgggtgcagagagcgcccctcccggacaggtaaggtttagcaagtcatgcttgaccctgttagtgcttttttattcctacatcatattgaggaaggaatggagctgtttttttagtgatgaagatgttttcctggtgatgcattcacactttcaactggcccttcctagatcaaagttagtgcctttgtgagatggtggcctgccagagtgtggtttgtggtcccatttcagggggaagatacttgactcatctgtggacctaattcacatcctcagcn

SEQ ID NO: 454983 - DNA, 8007 bp, Homo sapiens
cagggcagccccagctcagactccccagcgccagcctttacaccgcttcctcctcggaaaaagaagaattttttcttgaactggaactgcaactaaagtccgttcggagatccaaaaatctgcaatacagaggttatttgtaacccggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacacgatttatattaggatctgcccatgatgcggatattggtagcaacacactgcagaattaccaactcagtcccagtgatcatttctcactgataaataaagagaaatcagatggcagtaaataccctgagatggtattgaagacacctttggacagagaaaagcagaaatcctaccacttgactttgactgccttggactttggagctccacccctaagcagcactgcacagatacacgttctagtgactgatgccaatgataatgctccagtgttcagtcaagacgtatacagggtgagcctttcagaaaacgtgtacccggggaccacggtgctacaggtgactgccacggaccaggatgagggtgtcaatgccgagattactttctctttcagtgaagctagccagatcacccaatttgacctgaactctaacaccggggaaattactgttttaaatacattagattttgaagaagtcaaagaatattccatagttttggaagcaagggacggtggaggaatgattgcgcaatgcacagtggaggtagaagtcatagatgaaaatgacaacgccccagaagtgatattccagtctctacccaacctaattatggaggacgccgagctgggaacacatattgctttgctcaaagtccgtgacaaggattccagacacaatggagaagtgacttgtaaattggaaggtgatgttccatttaaaatattaacttcttcaagaaacacgtataaattagtgacagatgctgttctagaccgcgagcagaatccagagtacaatataaccgttacggcaacagatcggggcaagcctcccctctcctccagttccagcatcaccctgcacattggtgatgtaaatgacaacgctccggttttctcacagtcttcctatatagtccacgtggccgagaacaacccgcctggagcctctatttcacaagtcagggcttctgatccggacttggggcccaacggccaagtctcttactgcatcatggccagtgacctggagcagcgggagctgtcatcctacgtgtccataagcgcggagagcggggtggtgttcgcgcagcgcgccttcgaccacgagcagctgcgcgccttcgaactcacactgcaggcccgcgaccagggctcgccagcgctcagcgcgaacgtgagcctgcgcgtgttagtggacgaccgcaacgacaatgcgccacgggtgctgtaccccgcgctgggtcccgacggctctgcgctcttcgatatggtgccgcacgctgcagagcctggctacttggtgaccaaggtagtggcggtggacgcagactcaggacacaacgcctggctgtcctaccacgtgctgcaggctagcgagcccgggctcttcagcctggggctgcgcacgggcgaagtgcgcacagcgcgtgccttaggcgacagggacgccgtccgccagcgccttctggtcgccgtgcgtgacggtggacagccaccactctcggccactgccacgttgcacctggtcttcgccgacagcttgcaggaggtgctgccggatatcactgaccgccccgacccctctgacctccaggctgagctgcagttttacctagtggtggccttggccttgatctcagtgctcttcctcgtggccatgattctggccattgccttgcgcctgcgacgctcctccagccccgcctcctggagctgcttccagcctggtctctgtgttaaatccgaatccgtggttccccccaactacagcgaggggactttgccttattcctacaatctatgtgttgcacatacaggaaagacggagtttaatttcctaaaatgtagtgagcagttgagttcaggacaagacatactttgcggtgattcatctggggccttatttccactttgtaattccagtgaattgacttcccatcaggtgagtttcctttaagtataatttaatgctcattgcctacccatttctccatattcacaagaaaatatacatatttgcaggaaaatatataatttttagatgtcatggatcattttaggaaagttgtagtcagttaaaaagctgtcatatcattctacaaaggaggagtaaagtaggagcaattgtgtggcccaacatttgtttgttttttagccaagcttagatttataaagcaatgagggtgtggttttaaccacaaagtgaaagtgttagacagttgttggctctctcctaaaaagtgaatgagatttttcctatacattttccttcttgttgactaatatatgatgaatacttttttcagcttggatataccataaatataaaaataataaagccaaagaatttaagctaaaattcaacacttttcttaactaatttaactggtatggtctccatagtagtccactgttttgtttcctgtgttaacttcccttttgtttcaaaagctcttagaataaggagtcaactggatttttatgtccatggaccccttgtgattatatgcagtgtacgctgtgtgtgcgtgtgtgtgtgtgtgtgtgtgagagagatccttttacttagaaaaaggtctactatgctcattagaagatcaaaagcagattctccttacttgtaacataggagtttcaggattaatctgtattcaagctcattctatatccttcatcaaagaaaagacaatgttttgtgtctgttgtccctctcacacacagccctaatatataatgtgtaactgccttatctgcagccctaaactaatatagctagaggtcttctaatcattctcctacctctaggaaagaaatatagtcttgaaaactgccaatctggtgtgcatacaaaatatatacaaaataccaaggaacattatatgagccttttgctaggtatatctaagcaactgcttcagttaatggccactttacaaattgctgaaagaaggaaacgtctttcgattcttttttttttctttttttttttttgagacagagtctctgtctgttactcaggctgtagtgcagtggcacaatgatagctccctccagcctcaaactcctgggctcaagcattccttctgcatcagcctcctgactagctggaactcaggctcatgccaccagacctggctaatttttctgttttcagtagagaaaatattttctttcactaatttaactggtatggtttccattgtctacccagttttccatatgcataagaaaatatattcacaggaaaatataaagttttcagatttcatgagtggttttaagaaagttttagtcagtgaaaaaactatcataccagtcttcaaaggaagggtgaaataagttcatctgctacgttgcccaggctggtcttgaagggaaacagacttttttgtagtcatacttatcctttggcttcttagtaagtattatatagtcattactttttgcagttttttagatcaaagtgttaatgtaggtaaagttaattttagaatatatgtaaaagtcaagtctgctttaaatttaatcatctctttggtgaaagggatgggatggagctttgctttttatcatatattcatctgtacctttcaagtattcaaatagaaaaatataaacaatgtaaataaaatagcaaaacaatgtaatatctcataaaactgcaatggtaaaagcatttatcctattgaaattccacaatttttatttgaaaatattatcgacatgtaattcaagtggcatttagaagaataatttaaaagcaacaactctatagaaagcttgtaaaatgattaagtagtttaaaccaaataaaacaatttctgagtcagtcatctccagtaggtctattttagtctcaagataaattcatttctggtgacaactgaagttcttagttatttgttagtatatattggagacatttacaataaagcttagagcacaatgggaaatgaaagtatcatgttttttttaagaccaaatgtattgcagaaatgtgagtaatttaatccgatgctacaatctgatcattctgatctaatctgatcatttaataacactaaataaaaccttcatctcacattctttggctgtttcttttaaaatatgggtttacggataaatcaaataaattcaaaacaaagtaataagcaaatgatttttttttctcagtaatctagtagagtattacatttagaagtaatctgtatctcagtgcagtaactatttaggactgtaagcgccgctgttcacctactggaagacaaatgcaaccgaaaacactcagatctcacacctcacgaagacccgcagatgccacaaactaactgctggactgcagcgaaacccgacccctgtttggaggcactccaggtttccggaggattgtcatctccatagctgcggcaagaaactaaataagacccatttatgcacagtgaagattctgagaggattctgcagcaaaacaacaatggccgctccacagagtcgccccagacgcggcgagctgatcctgctgtgcgcgctgctgggaacgctgtgggaaatcgggaggggacagattcgctactctgtgccagaagagacggacaaaggctccttcgtgggtaatatctccaaggacctggggctggacccccggaagctggcgaagcacggagtccgtatcgtctccagaggtaggacgcagctctttgctctgaacccgcgcagcggcagcttgatcaccgcgggcaggatagatcgggaggagctctgcgctcagagcccgcggtgtctgataaatattaacaccctggttgaggataaaggaaaactctttggggtagaaatagaaataattgatattaacgataataacccaaaattccaggtcgaagatctagaagtaaaaattaacgaaatcgcggttcctggagcacgttatccactcccagaagctgttgacccggatgtgggcgtgaactccctccagagctaccagctcagccccaatcaccacttctccctggacgtgcagactggagacaatggagccataaacccagagctggtgctggagcgcgccctggacagggaggaagaggctgctcaccacctggtcctcacggcctcggatggcggcaagccgcctcgctctagcacagtgcgcatccacgtgacagtgttggatacaaatgacaatgccccggtttttcctcacccgatttaccgagtgaaagtccttgagaacatgcccccaggcacgcggctgcttactgtaacagccagcgacccggatgagggaatcaacggaaaagtggcatacaaattccggaaaattaatgaaaaacaaactccgttattccagcttaatgaaaatactggggaaatatcaatagcaaaaagtctagattatgaagaatgttcattttatgaaatggaaatacaagccgaagatgtgggggcacttctggggaggaccaaattgctcatttcggtggaagatgtaaatgacaatagaccagaagtgatcattacgtctttgtttagcccagtgttagaaaattctcttcccgggacagtaattgccttcttgagtgtgcatgaccaagactctggaaagaatggtcaagttgtctgttacacacgtgataatttaccttttaaattagaaaagtcaataggtaattattatagattagtgacaaggaaatatttggaccgagaaaatgtctctatctacaatatcacagtgatggcctcagatctaggaacaccacctctgtccactgaaactcaaatcgctctgcacgtggcagacattaacgacaaccctcctactttccctcatgcctcctactcagcgtatatcctagagaacaacctgagaggagcctccatcttttccttgactgcacacgaccccgacagccaggagaatgcccaggtcacttactctgtgaccgaggacacgctgcagggggcgcccctgtcctcgtatatctccatcaactctgacaccggtgtcctgtatgcgctgcaatctttcgactatgagcagatccgagacctgcagctactggtaacagccagcgacagcggggacccgcccctcagcagcaacatgtcactgagcctgttcgtgctggaccagaatgacaacgcgcccgagatcctgtaccccgccctccccacagacggttccactggcgtggagctggcgccccgctccgcagagcgtggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagatgcgctcaagcagagcctcgtggtggccgtccaggaccatggccagccccctctctccgccactgtcacgctcaccgtagccgtggctgacagcatccccgaagtcctgaccgagttgggcagtctgaagccttcggtcgacccgaacgattcgagccttacactctatctcgtggtggcagtggctgccatctcctgtgtcttcctcgcctttgtcgctgtgcttctggggctcaggctgaggcgctggcacaagtcacgcctgctccaggattccggtggcagattggtaggcgtgcctgcctcacattttgtgggtgttgaggaggtacaggctttcctgcagacctattcccaggaagtctccctcaccgccgactcgcggaagagtcacctgatctttccccagcccaactacgcagacatgctcatcagtcaggagggctgtgagaaaaatgattctttgttaacatccgtagattttcatgaatataagaatgaagctgatcatggtcagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctg

SEQ ID NO: 454984 - DNA, 1437 bp, Homo sapiens
attggctgggactctgtgtgccgctgtcggccaatgaagacgctggagatcgggcccctgcccgtcccctttctgcgccccgggatgaggcagagactgaacagccggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcatcccggttacaagggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaaga

SEQ ID NO: 454985 - DNA, 2489 bp, Homo sapiens
atgaccaattgcctgagtttccgaaatggcagaggactggccctgctgtgcgcgctcctggggacgctgtgcgaaacaggatccggtcagatccgctactcggtgtctgaggagctagataaaggttccttcgtgggcaacatcgctaacgacctggggctagagccccgggagctggcggagcgcggagtccgcatcgtctccagaggtaggacgcagcttttctctctgaatccgcaaagcggcagcttggtcaccgcggagaggatagaccgggaggagctctgcgctcagatcccgctgtgtctggtaaaaattaacattctggttgaggataaattgaaaatttttgaagtagaaatagaaattaaagatattaatgataatgctcctaatttcccaacagaggaattggaaataaaaattggtgaactaacggttcctggaacccgatttccaattaaaactgcttttgacccagatgtaggcattaactccctgcagaactacaagcttagccccaatgactacttctctctggctgtgaatagcgtctctgagggggccaagtatccagagctggtgctggagcgggccctggaccgtgagaaaaaagaaattcaccagcttgtcctggttgcctctgatggtggcgaccctgtccactctggcaacttgcacatccaagtgatagtcctggatgcaaatgacaacccaccaatgtttactcagcctgagtaccgtgtgagtgtttgggagaacgtgcctgtgggtacccggctgctcacggtgaatgccactgaccctgacgagggattcaatgctcaagtgtcttatattctagataaaatgcctgggaaaatcgctgagattttccatcttaactcagtgagtggagaagtatcaatattaaaaagtctagattatgaggatgccatgttctatgaaattaaaattgaagcacaggatggaccaggtcttctttcaagagccaagattctagtcacggttctggatgtgaatgacaatgctccagaaattacaatcacgtctctcacaagctcagtcccagaagagggcaccgttggaagagaaattgctcttatcgacgtgcatgaccgagattctgggcagaatgggcaggttgaagtttttgtcctgggaaatctgccatttaagttagaaaaatcaatagatcaatattaccgcttagtgacggccacatccctggaccgcgaacaaatatcagaatataacattagtctgagagcctcagatgggggaagcccgccactgtccacagaaactcacatcaccctgcatgtgattgacatcaatgacaacccacccaccttccctcatttatcctactccgcctacattccagaaaacaaccccagaggagcctccatcttctcagtgacagcccaggacccagatagcaacaacaacgcccgcatcacttatgcattgaccgaggacactctccagggggcgcccctgtcctccttcgtctctatcaactccaacactggcgtcctatacgcgctgagatccttcgactacgagcaatttagagacttaaagctactggtgacagccagcgacagcgggaaccctccactcagcagcaacgtgtcgctgaacctgttcgtgctggaccagaacgacaacgcgcccgagatcctgtaccccgccctccccacagacggttccactggcgtggagctggcgcctcgctccgcagagcccggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagacgcgctcaagcagagcctcgtggtggccgtccaggaccacggccagccccctctctccgccactgtcacgctcaccgtggccgtggccgacaggatccccgacatcctggccgacctgggcagcctcgagccctccgccaaacccaacgattcggacctcactctgtacctggtggtggcggtggccgcggtctcctgcgtcttcctggccttcgtcatcgtgctgctggcgctcaggctgcggcgctggcacaagtcacgcctgctgcaggcttcgggaggcggcttggcgagtacgcccggctcgcactttgtgggcgcggacggggttcgggctttcctgcagacctattcccacgaggtctccctcactgcggactcgcggaagagccacctgattttcccccagcccaactatgcggacacgctcatcagccaggagagctgtgagaaaagcgagcctcttctgataactcaggatttacttgaaatgaaaggagattccaacctacttgctggacgaggacgaggatgagcgtgtggaaaaggctgacctgcggcaactcacggagatgggctaac

SEQ ID NO: 454986 - DNA, 642 bp, Homo sapiens
cgcaccgcctcttcctcctggaagctatataatgatatcgcgtcacttccgctctctcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaagtcgacgcggccgcgaatttagtagtagtagggtcagc

SEQ ID NO: 454987 - DNA, 614 bp, Homo sapiens
gacccacgcgtcgcggacgcgtgggtcgacccacgcgtcgcggcggtgcgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaagtcgacgcggccgcgaatttagtagtagtagggtcagc

SEQ ID NO: 454988 - DNA, 716 bp, Homo sapiens
taccatgtcgaccacatgcaaggctgggagaacccgggataccttctggccaaacgcccagtttagcgccctcgggtccagactactgcagctcctgctccaataccagcgccaaacctggcgtgatcttcacgagtgcaacaccaggtctctcgggttgcacaccccccactgtgggccgggggaccgctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 454989 - DNA, 456 bp, Homo sapiens
  misc_feature (20)..(20): n is a, c, g, or t
  misc_feature (52)..(52): n is a, c, g, or t
  misc_feature (81)..(81): n is a, c, g, or t
  misc_feature (101)..(101): n is a, c, g, or t
  misc_feature (120)..(120): n is a, c, g, or t
  misc_feature (159)..(159): n is a, c, g, or t
aaggcagcatgagtgagttnaacccctttgggtccaacccatggtctcctgncccctgtagagtgaagggcttcttttttnctttttagttttttttaagncagagtcttaaaaaaattncccaggctctttttttaagagtcttaaaaaaactcttgnccaaaaaaaacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 454990 - DNA, 800 bp, Homo sapiens
ctgcctctttaagactaggactgagagaaagaagaggagagtagaaagaatagggagacgaagtttgagccccaggcttaagcctttccaagagaaataataactaacaactcactcgtgcgcgcggcaggatctggccacgaggaggagggaagcgctttgttttgatcctgattccagtttgcctctctctttgttttcccccaatattattcttacgcctgtattttcctcgcgtgagcccttgcgctcccgtacaccccggacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaaaaaaccaaaaaacctcggggatctattatatagacagagatgcgacacacacagaaggtccactacaaacgcggcggacatgtgagtccaacatataccggtgtcttctctgtggaaccccaaaagatttctatgctacaaaaagttggctaaaacttatgcagagagcaccacctataataggtagactccgagacattaacttccaaattaacccaagcggtaaaccctagctttata

SEQ ID NO: 454991 - DNA, 456 bp, Homo sapiens
gcggccgcctactactactactactgctcgaattcaagcttctaacgatgtacggggaggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 454992 - DNA, 776 bp, Homo sapiens
gcacgagatatggtacagttctttgtacagaaaggcaccattatgttagaataaatttccagaacttagtgggaagaatcaggttttaaccttgtgtgtctgttacttctgagtgcatttctataatataaatgttgatttgcatcaacattataaaagagcacttctgtggctcatttaaaagaaaaaaaaggttaagtcttttaaattttggccttgtttccaaatcctgtcttccatgttgtttttctgcacttcctgaccactcttataaaaagctcacaaacctttgaagaaactggagtaggctgttatttcattaaggtttacaaattaaatgcttgatttctcgtgccgaattcggcacgaggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 454993 - DNA, 598 bp, Homo sapiens
cgcaccgcctcttcctcctggaagctatataatgatatcgcgtcacttccgctctctcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 454994 - DNA, 737 bp, Homo sapiens
gagtgaaaagggcccccagaagtttctgggggtgtgagacaaaacgttggtctaaaaaggtttgtgtcaagagtcaggcaatgaaggcttctagctctttggtgtctcctgaatttagctttctgaggagtgacagcgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaaaaaaacactggcccgcgttttacaactcgtgactgggccctggggtaccccacttaatgcgcttgaggaaat

SEQ ID NO: 454995 - DNA, 502 bp, Homo sapiens
gggctgcaggaattcggcacgagccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 454996 - DNA, 654 bp, Homo sapiens
  misc_feature (51)..(51): n is a, c, g, or t
actccttcaaaccatggggtagcactacgaagtttcatctacctcttcagntgtatcgatcactaggctgtgctcattcaactccatctccaactcagctgctttggatgccagctcgtgccgaattcggcacgacgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 454997 - DNA, 548 bp, Homo sapiens
taggctggtggaggcggggtgagtcggacgagggcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 454998 - DNA, 564 bp, Homo sapiens
aaacttacggctaggtacgaggctgggtgtggggaggctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 454999 - DNA, 881 bp, Homo sapiens
taggctggtggaggcggggtgagtcggacgagggcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaaaaaaaaaaaaaaaaaaaaaaaaaagggggggggaaaaaaattccccgggggggcccaagtttgcgggtcacccgtttttttgaccaagggggccccaataggggagggtggtaaaaaaacgaaaggagagagggccagagtacacacgcgcggggcgtgggaaaactggcgacgcgggcacctgggagaggagcccctacccggtgggcggacactactgcggcagcaacccaaaaaagttaaccgctagggaacattaaccttcccgtgcacggggacccaccatatcgtggcgcaaaaattggcaccagactagacagaattac

SEQ ID NO: 455000 - DNA, 915 bp, Homo sapiens
gctgtaaagagcgcgatgagtattttggcaaggacacccccgtgtcgcgaccggaagtgtaaagcacaatgtgtccctgcctgagacgaggactgcgtcccgacaagagtgttactttggcggggcggcgcaaacaattgccaggggccgcccccgttcacctgtgatggaggaccaattgccgcgtttgcagatgcgccacaagatagtcgcgtgtcttcgttgtcggttccgaaagactctggcaccggatgttgcaacgggacccttggagcggcatggctccgagcgtggactagacaacgctcagccgggcggacacgccccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaggtttgattcatccattttgaagagacgggggagcggggggctcgtctgttccaggagccc

SEQ ID NO: 455001 - DNA, 431 bp, Homo sapiens
gggctgcaggaattcggcacgagctctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagcgtggattcagcatattttgcgagtactcaacaccaacatcgatgggcggcggaaaatagcctttgccatcactgccattaagggtgtgggccgaagatatgctcatgtggtgttgatt

SEQ ID NO: 455002 - DNA, 658 bp, Homo sapiens
gagtgaaaagggcccccagaagtttctgggggtgtgagacaaaacgttggtctaaaaaggtttgtgtcaagagtcaggcaatgaaggcttctagctctttggtgtctcctgaatttagctttctgaggagtgacagcgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 455003 - DNA, 570 bp, Homo sapiens
gacccacgcgtcgcggacgcgtgggtcgacccacgcgtcgcggcggtgcgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 455004 - DNA, 455 bp, Homo sapiens
ctctagagcggccgcctactactactaaattcgcggccgcgtcgacacggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 455005 - DNA, 500 bp, Homo sapiens
ctctagagcggccgcctactactactaaattcgcggccgcgtcgacacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 455006 - DNA, 892 bp, Homo sapiens
ctggcttttgccacgcacttttgggaatgggcaggagacctgcttcctctctccagaggttgcattttcccaagcttgaacgcttcatgtgcctactctgcaggactgaggagtttgctctgtggtgtgaaaacctaaggaatggggggcgggtgtcttgccacttgtgtgacaggcttaacctttttgtatgaagttcgtttgccttatcggccttactgtttgatagtttactgtgtctgatttcttcccccgtactttttcaactagttctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaaaaaaactcatagaacctcctcacattcactccgcaacacaaacaaaaaagggggggggcgcccttaaaaaaatttctcccggaggagggccccattttacaatcccct

SEQ ID NO: 455007 - DNA, 529 bp, Homo sapiens
ggagggtttggttgagctgcagctgtttgtctgttcgatcacaggcttgcgggcctggaatcggtgggagacggagaccccacgagtagatgttgtaagccgtggaaatcctcactcctttgggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 455008 - DNA, 576 bp, Homo sapiens
  misc_feature (19)..(19): n is a, c, g, or t
  misc_feature (45)..(45): n is a, c, g, or t
  misc_feature (167)..(167): n is a, c, g, or t
gactcacgcgtgcgccgtntgacatgacccggctcagatccgccngtgatcgctcgaagcgcgagggcccaaggagctaacccgcggtctcaccatttctgtacctgaagtccacaatttgcgagtctcacccactcgatggcgcggaaataccttgcctcatgccnagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 455009 - DNA, 813 bp, Homo sapiens
aaagcagacattgacctcaccaagagggcggcggaaaatagcctttgggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaaaaaaaaaaaaaaaaaaaaaaaaaaaaaaaaaaaaaaaaaaaaaagggggggggggggggaaaaaaattccccgggggggcccaagtttgcgggtcacccgtttttttgaccaagggggccccaataggggagggtggtaaaaaaacgaaaggagagagggccagagtacacacgcgcggggcgtgggaaaactggcgacgcgggcacctgggagaggagcccctacccggtgggcggacactactgcggcagcaacccaaaaaagttaaccgctagggaacattaaccttcccgtgcacggggacccaccatatcgtggcgcaaaaattggcaccagactagacagaattac

SEQ ID NO: 455010 - DNA, 717 bp, Homo sapiens
ctgggctgtagtgcgctatgccgatcgggtgtccgcactaagttcggcatcaatatggtgacctcccgggagcgggggaccaccaggttgcctaaggaggggtgaaccggcccaggtcggaaacagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaaaaaaatcacaaattcaatcttacactcttcatcatacctcctcgaccattcctacgcttattcataccctcggagggggggcccgtacccaaattgcgcctatggggggtgtctttccacttccactggccgtcttctataacggtcgtctatgctaaacccctggctaacctcattttaagggcttctactaaaccccttttggcacactgctgtcttaccaaaatggccgacccatcccctttcc

SEQ ID NO: 455011 - DNA, 397 bp, Homo sapiens
tgcggccgctccaacatcagaatggtaatcacacgttccacctcatcctcagtgagttctcccgccctcttggtgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 455012 - DNA, 659 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaagtcgacgcggccgcgaatttagtagtagtagggtcagc

SEQ ID NO: 455013 - DNA, 974 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaaaaaaaaaaaaaaaaaaaaaaaaaaaaaaaaaaaaaaaaaaaaaaaaaacagggggggggaaaaaaattccccgggggggcccaagtttgcgggtcacccgtttttttgaccaagggggccccaataggggagggtggtaaaaaaacgaaaggagagagggccagagtacacacgcgcggggcgtgggaaaactggcgacgcgggcacctgggagaggagcccctacccggtgggcggacactactgcggcagcaacccaaaaaagttaaccgctagggaacattaaccttcccgtgcacggggacccaccatatcgtggcgcaaaaattggcaccagactagacagaattac

SEQ ID NO: 455014 - DNA, 1005 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaggagggggcggcggccccaaatttctctcccggggggggcacgcgcgcgccccccaagcagttgttgtctgtaacaaaagaggggccgcccctcaatgtagaggcgggctgatatatttattataagacgaggagcgacagggccgccggttcgttttataaacaaagcgtactagtgcggaggaaaaacaagaggcgtgcgacggcgaacattctttgatgagaagagccactatctttctgtgggagaggagaacaactattgacaacacacaccctcacaagagtttaccg

SEQ ID NO: 455015 - DNA, 737 bp, Homo sapiens
  misc_feature (679)..(679): n is a, c, g, or t
  misc_feature (683)..(683): n is a, c, g, or t
  misc_feature (687)..(687): n is a, c, g, or t
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaaaaaaaaaaaaaaaaaaacaccgcgggggcctatattgggggggggggaaaaaagggnttanaaangggcaggggccaaggtgtttttcgggcacccattttttttgttcccaggg

SEQ ID NO: 455016 - DNA, 802 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaaaaaaaaaaaaaaaaaaacaaaaaaaaaatcgggggggttttatggcgggggggggaaaaaggggtctaggaatgggccactggcaaggtgtgttcccgaacccgtttttctggcacccgggcgaaaactgggcggtcccataaaagggggcgttaaattcctaaaaccgtgtacccgtta

SEQ ID NO: 455017 - DNA, 675 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctagaaaaaaaaaacaaacttgaaggggggcccgggccccaattggcctattgggaagggtat

SEQ ID NO: 455018 - DNA, 1009 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaggggggggggaaaaaaattccccgggggggcccaagtttgcgggtcacccgtttttttgaccaagggggccccaataggggagggtggtaaaaaaacgaaaggagagagggccagagtacacacgcgcggggcgtgggaaaactggcgacgcgggcacctgggagaggagcccctacccggtgggcggacactactgcggcagcaacccaaaaaagttaaccgctagggaacattaaccttcccgtgcacggggacccaccatatcgtggcgcaaaaattggcaccagactagacagaattac

SEQ ID NO: 455019 - DNA, 713 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgaggctaggacaggctaggaccactggcgaggctaggacaccactggcgaggctaggacactggcgaggctaggacactggcgaggctaggacactggcgaggctaggacactggcgaggctcggacactggcgaggctaggacactggcgaggctaggacactggcgaggctagga

SEQ ID NO: 455020 - DNA, 739 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggggtgagtggggggtctcatctccctgcctacctcgactcagcattcctcctactcgctcttctttttccccaaccttttgtttctgctgtgcatgacctgtgactcttctctttttacctgcagccttcgtgtccgaggccagcacaccaagaccactggccgccgtggccgcaccgtgggtgtgtccaagaagaaataagtctgtaggccttgtctgttaataaatagtttatataccta

SEQ ID NO: 455021 - DNA, 1048 bp, Homo sapiens
taccatgtcgaccacatgcaaggctgggagaacccgggataccttctggccaaacgcccagtttagcgccctcgggtccagactactgcagctcctgctccaataccagcgccaaacctggcgtgatcttcacgagtgcaacaccaggtctctcgggttgcacaccccccactgtgggccgggggaccgctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaacaaaaaaaaaaaaaaaaaaaaaggggggggggaaaaaaattccccgggggggcccaagtttgcgggtcacccgtttttttgaccaagggggccccaataggggagggtggtaaaaaaacgaaaggagagagggccagagtacacacgcgcggggcgtgggaaaactggcgacgcgggcacctgggagaggagcccctacccggtgggcggacactactgcggcagcaacccaaaaaagttaaccgctagggaacattaaccttcccgtgcacggggacccaccatatcgtggcgcaaaaattggcaccagactagacagaattac

SEQ ID NO: 455022 - DNA, 624 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 455023 - DNA, 733 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtgtgtactgaaatgagggcaggattagaggaagggtggagggtcctaacagaattgggcataggaggtcaggggataaaacatcccttgccccctcctctgaatccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 455024 - DNA, 869 bp, Homo sapiens
  misc_feature (804)..(804): n is a, c, g, or t
  misc_feature (851)..(851): n is a, c, g, or t
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtgtgtactgaaatgagggcaggattagaggaagggtggagggtcctaacagaattgggcataggaggtcaggggataaaacatcccttgccccctcctctgaatccaggtcctagccaatggtctggacaacaagctccgtgaagacctggagcgactgaagaagattcgggcccatagagggctgcgtcacttctggggggtgagtggggggtctcatctccctgcctacctcgactcagcattcctcctactcgctcttctttttccccaaccttttgtttctgctgtgcatgacctgtgactcttctctttttacctgcagccttcgtgtccgaggccagcacaccaagaccactggccgggggactcgcaagatggcgccgcanaagacaggaagcccggtcaacctgaagttaatttggaccttctcatncagtagaagaggtttttg

SEQ ID NO: 455025 - DNA, 1081 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaaaagtttgctgcggcaaggacgagccggggcgctgaagactatgctccaggaagccaggtgtttcgaggacttgcttctacggttctttgtctgccggaatcagggaagagtgaaaagggtcagcacagaattccaagaagcaaagtccaacaaaaactcctctgattctgaatctgatgatgagggtgacgtttcagaggtcactctcgagtggtgagcaaggcagaagggattcgaaaaccagagtctcatcctttgaaaacgaggccccgagtcagtttcagaaagaagaacttgctggaccgctgtggattatgtcacgagagccacacgcagagaagtccgtacctacaggggatggagaccacccagcccatcgcatcagttggcctcggcagtgcatcttcagcgtcgacccctggcttccacattgcgggacctttcgcagcc

SEQ ID NO: 455026 - DNA, 842 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaaaaaaaaaaaaaaaaaaaaaaaaaaaaaaaaaaaaaaaaaaaaaaaaaacaaaaaaaaaatcgggggggttttatggcgggggggggaaaaaggggtctaggaatgggccactggcaaggtgtgttcccgaacccgtttttctggcacccgggcgaaaactgggcggtcccataaaagggggcgttaaattcctaaaaccgtgtacccgtta

SEQ ID NO: 455027 - DNA, 984 bp, Homo sapiens
  misc_feature (895)..(896): n is a, c, g, or t
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctatcaccaaactcttcactgggcgtcgataacacagtgggagcgggaaccgtgggttccaagttatcgttgaggcattccctttgcagaggggaaagaaaagccggctatgccttccacgttggccttcatgatggatggaggacatcgtaatcgtactggtaccgctaacaaggaatgaatctaacaaaacgaaggtgttctggaagccaaaagtccccggagtgaggcgacccatggggaagcgaccggtgaaacctctcccactacttcnnagcagacgacaccagctcaaccaaaaaacaccaaagacaaccacaggacaccgcacagcagcgccaagcaccgacaacaacccagagc

SEQ ID NO: 455028 - DNA, 1003 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctataaacaaaacaaaggaagacccagaacagacacgcacaaaaccacaagagaaacccagcacagcaaacaacagacaggaccacaacacactgacaaagagaccacagaaacacaagcacggggggcggcgggcgccacacaatgcactgcaccggtcgacgcggaaggacggcaccagtacgatgacatgcgcacagcatgaaccatgttgaccgcagccatcgcggcgggggcacgtcaacactgaggcagtagatcaatatacataaacgagcacgagacgagcggccggacctgcgagacaagagagcaggcgcgcggcgagcgccagcaaaatgacggagatctcagcgggtaccgcctcggggagtcgacaacc

SEQ ID NO: 455029 - DNA, 905 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaacaaaaaaaaaaaaaaaaaaaaagggcgccgtcgcgatcaaaattagctggggccggaggtgccctgggaaaggccatgggacttcatcggccccgggcccgggccccattaacctctactttcttcattgggtagtgggggtctgtgcactggggatataacttgagggcaacagtgaaacatcttcaagcgggagccatccgctcattaaggccctaccaagggggtcggttccagttctatgcaccctctggggattccaggcagcacttag

SEQ ID NO: 455030 - DNA, 742 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaataaataaaaaaaactcgaggggtgtcccggaccccaattgccctaagtgaggtcgattacaactcatctgccgtcgctatacaaccgcttgattggggcctggcgaatatccct

SEQ ID NO: 455031 - DNA, 678 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaagacatgaacaaagtaaagaaccacgtagcatagacaaacaaaaacaac

SEQ ID NO: 455032 - DNA, 739 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaaaaaaactcatagaacctcctcacattcactccgcaacacaaacaaaaaagggggggggcgcccttaaaaaaatttctcccggaggagggccccattttacaatcccct

SEQ ID NO: 455033 - DNA, 894 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaatggtactgaacctacgagtacaccgactacggcggactaatcttcaactcctacatacttcccccattattcctagaaccaggcgaactgcgactccttgacgttgaacaatccgagtagtactccgcgattgaagcccccattcgtataataattacatcacaagacgtcttgcactcattgagctggtcccacatttaggcttaaaaccagatgcaatttcccggaacgtctaaagccaaccactttcccccgctacacgaccggggtatactacggtcaatgtcctgaatcctggggagccaaccacaggttcatgcccatcgtcctagaattaattcccttaaaatctcggcatag

SEQ ID NO: 455034 - DNA, 581 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggaggagccatcgctgtgcacgagaccagcaaatccaagaccagcttggccgccgagtacgaccagggagcagtac

SEQ ID NO: 455035 - DNA, 569 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggcttcgtgtccaggcagcacactagacactgccgcgtgcgcacgtggtgtgtcagagattagt

SEQ ID NO: 455036 - DNA, 1259 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccagccttcgtgtccgaggccagcacaccaagaccactggccgccgtggccgcaccgtgggtgtgtccaagaagaaataagtctgtaggccttgtctgttaataaatagtttatatacctaaaaaaaacaaaacaaaaaaaccaaaacaacagaaaaagaccgaagccaccaacaaagcacaaccacgaaaaaccaaagcaagcacaacagacacacacgggggcgggacttacatcaggcggggcggaagaacaacaagcagagcggtcacacaaagcggcgaaccggacagcacaaacacgcgggcgacccgagccacacccaccccccgaccccacacaacaccacgcgcacacccacagggcgcgagactcaacaaagaatgagaggagaacagcaacaattaacaccgcccacacaccagcgcggcatacaactgacgcgcgtaataaagcacaacgcgcagaacccaccgcacagagcacgaacaacgacagacaccagaacagcgccagcaaacgcatacaccagaagcgcgacaacacacagcaagagtacagagaaagcaaaggaggagacaagaaagaaggaaggacagtgggacgtacgaggacaaagcagtgaagaagacagcgagccgcgaaggccggagggaaacgggcgagcaggtgacggattgtccgagacgaggtaagtacgtggtggggggcagggttgggatgtgggttagcgagtggtgagggggggtggggcgacgagatcgggttatgggagatagaagcatagggagagagcgcgggagagagtgtcagagaaggtagaggagggcgacggaggagaggcgggg

SEQ ID NO: 455037 - DNA, 574 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 455038 - DNA, 856 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtggatatttgaatggttttaaaccattcaaatatccacatttaatgtacgtaaaagggtgtttttgtaaatgcaaagattaaatcagacagcctctgaattgtagtcttgaaaacattagcaagttcttttaggtccagggtagatactgcagttcacttagccaactttctgcattgagacatccttgccagggatcctgtcagttatgcgaagatgcggcacgagataattcctcttgctgtgatggttcgtcctcaatgacaggtcccttatagtatttaggtacaacaaggtcttttgtgcttggaatgcccttgaaaaagctgcctcacctgtttgtgaagggaaccccaaagagaaagggagaggaagggctgggtgcagtggctcacatctataatcccagcactttgggaggccgaggtgggtggatatttgaatggttta

SEQ ID NO: 455039 - DNA, 943 bp, Homo sapiens
taccatgtcgaccacatgcaaggctgggagaacccgggataccttctggccaaacgcccagtttagcgccctcgggtccagactactgcagctcctgctccaataccagcgccaaacctggcgtgatcttcacgagtgcaacaccaggtctctcgggttgcacaccccccactgtgggccgggggaccgctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaaaaaaaaaaaaaaaaaaaaaaaaaaaaaaaaaaaaaaaaaaaaaaaaaacaaaaaaaaaatcgggggggttttatggcgggggggggaaaaaggggtctaggaatgggccactggcaaggtgtgttcccgaacccgtttttctggcacccgggcgaaaactgggcggtcccataaaagggggcgttaaattcctaaaaccgtgtacccgtta

SEQ ID NO: 455040 - DNA, 1127 bp, Homo sapiens
taccatgtcgaccacatgcaaggctgggagaacccgggataccttctggccaaacgcccagtttagcgccctcgggtccagactactgcagctcctgctccaataccagcgccaaacctggcgtgatcttcacgagtgcaacaccaggtctctcgggttgcacaccccccactgtgggccgggggaccgctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaaaaaaaaaaaaaaaaaaacatcgaaatagttctctctctcggggggggaaaagccttgagcagaaagtttctggggaaccctgtagagggggggcggaaatcctgcacggaaaccagcgcaaagcgccgcaagttcctggagacgggggaggttgcagatcaggcttgaagaacttttgatccccagaaggaaaagggtgtcggggcccgcacagggttaatccattccccgcctaagtctctgtgtgtgtctggggaccaccgctggacgaggtgggccggtatcccattgaatgcagggtagaaatcacagataaactggtcaatggcaattgagttggccaactgttagattccaatcgccgtaaagggaggctccggcaaccaatggcgtgg

SEQ ID NO: 455041 - DNA, 554 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatcctacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 455042 - DNA, 705 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtgaggacaaggaagggggctgggggtggggtcagcctcagaaaggggtccatctagatctgaccttggtctgcctgccaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 455043 - DNA, 1023 bp, Homo sapiens
taccatgtcgaccacatgcaaggctgggagaacccgggataccttctggccaaacgcccagtttagcgccctcgggtccagactactgcagctcctgctccaataccagcgccaaacctggcgtgatcttcacgagtgcaacaccaggtctctcgggttgcacaccccccactgtgggccgggggaccgctacacgccgccgcttgtgctgcagccatgtctctagtgatccctgaaaagttccagcatattttgcgagtactcaacaccaacatcgatgggcggcggaaaatagcctttgccatcactgccattaagtagagacagggtttcaccatgttggccaggctggttttgaactcctgccctcaatgtcatctgcccacttgggcctcccaaagtgctgggattacaggcgtgagccactgcgaccggcccaaagttaaccttctgtcgaacggtttatatctggaaaggtgggtgaggaaagggtgacctaggggattgcaaaatagattattgcagatcctacctttgtgagctttttgaatgaggctataaaggaatttaaaaatcagattcaacactaattccgaaacccctcacttcattcaggggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 455044 - DNA, 419 bp, Homo sapiens
  misc_feature (392)..(393): n is a, c, g, or t
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtgacgtgtatcacattatgcagatcacgcagtcaagatccagactggtcttgacagacagaggatgtaagatggaattcagcagtcnngcattgcttgcacagtccttagcctg

SEQ ID NO: 455045 - DNA, 392 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaaggtgagtgaagtagggtaaggaatagggaatgtaaatgagaattgggttgtgaagacataagcaaaaatgaagcaaggctggggagacttgagtctcatccagatcaccttgactgctggattaagaaaagaaagtggtttagggagagactgacccctttagcatttaccacaga

SEQ ID NO: 455046 - DNA, 615 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 455047 - DNA, 903 bp, Homo sapiens
taccatgtcgaccacatgcaaggctgggagaacccgggataccttctggccaaacgcccagtttagcgccctcgggtccagactactgcagctcctgctccaataccagcgccaaacctggcgtgatcttcacgagtgcaacaccaggtctctcgggttgcacaccccccactgtgggccgggggaccgctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaaaaaaaaaaaaaaaaaaacaaaaaaaaaatcgggggggttttatggcgggggggggaaaaaggggtctaggaatgggccactggcaaggtgtgttcccgaacccgtttttctggcacccgggcgaaaactgggcggtcccataaaagggggcgttaaattcctaaaaccgtgtacccgtta

SEQ ID NO: 455048 - DNA, 690 bp, Homo sapiens
  misc_feature (575)..(575): n is a, c, g, or t
  misc_feature (581)..(581): n is a, c, g, or t
  misc_feature (643)..(643): n is a, c, g, or t
  misc_feature (647)..(647): n is a, c, g, or t
gacccacgcgtcgcggacgcgtgggtcgacccacgcgtcgcggcggtgcgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctagtatntactanacgttacacgctgactgaaactgcgtacactatcgctgagacatccttgcagtgcgatacanaggngacgtcgcttcacagtgcagctatgcatgcaatgagctttgtt

SEQ ID NO: 455049 - DNA, 998 bp, Homo sapiens
  misc_feature (732)..(732): n is a, c, g, or t
aaacttacggctaggtacgaggctgggtgtggggaggctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaaaaaaaaaaacttccgggctcttttgtgggtggggaaaacggggtttgaatgcccttggtcatagctggttcctgaccagttttttggccagggggaaatttgccggctccctttaagggggcgataattcgaaaagcggtaacggctagattgcgccgaanccggggataaacccgcgacaaatagcggggcaaatgagcaggaggcaacactagtaacaacaaagcggagaccagaaggcaacagcacaaaaccggccacacggggatcgagcagaacacagaaacacactttacagaacaagcaataccagaaacacgaaaagcaccataagagcagacaacgacacaaccgacacagatccaagcaaacacgagacgactacgaaaaagactcagcagaaaaaagacagaacagaccagacgaa

SEQ ID NO: 455050 - DNA, 946 bp, Homo sapiens
  misc_feature (686)..(686): n is a, c, g, or t
taaaactaggctaggtcgagccgggtgttaacgccgccgctgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaaaaaaaaaaaaaaaaaatcgggggcatcatatgcgggggggggaaaaaaggggttggaaagggccatgggtcataaggggttccctggaccccgtttttgggtcccaggggggaaattnggcggggtcccccttttaagggggaggcgggtaaaatacttccgggaaacagcgcgggtcaacgggcttgatatctcgcgcgaagaaaacagagagacagaaagcgagcagcgagcaagaacgagccgactcagaaaacgatggacagatacgccgcaggaagacgaaacgactcgagcgacaacgtctgacaagacagaggaaagtactggacaccagaacacaaaacaagccgagagcagagacaggtacaaagaaaa

SEQ ID NO: 455051 - DNA, 851 bp, Homo sapiens
gctgtaaagagcgcgatgagtattttggcaaggacacccccgtgtcgcgaccggaagtgtaaagcacaatgtgtccctgcctgagacgaggactgcgtcccgacaagagtgttactttggcggggcggcgcaaacaattgccaggggccgcccccgttcacctgtgatggaggaccaattgccgcgtttgcagatgcgccacaagatagtcgcgtgtcttcgttgtcggttccgaaagactctggcaccggatgttgcaacgggacccttggagcggcatggctccgagcgtggactagacaacgctcagccgggcggacacgccccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 455052 - DNA, 933 bp, Homo sapiens
  misc_feature (5)..(5): n is a, c, g, or t
gaatncggcacgagcttgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggggtgagtggggggtctcatctccctgcctacctcgactcagcattcctcctactcgctcttctttttccccaaccttttgtttctgctgtgcatgacctgtgactcttctctttttacctgcagccttcgtgtccgaggccagcacaccaagaccactggccgccgtggccgcaccgtgggtgtgtccaagaagaaataagtctgtaggccttgtctgttaataaatagtttatatacctaaaaaaacacacataacgcggtgccccgatccaacagttttcccctccagtaggaggcccaaaggttacggcgtaccacgcattacgtgctcaaactgtgccatcccctaatagggaagtccgaaatcaataccgcctagggcctgtagccggacagttcaaccaaacgtccgtgcacggggaaaaccctgcataccctgtgagcaatccgtgcgcgacagcgacccttaaacctatcctgggatacttttaccctcttcttcggcacacaacttacc

SEQ ID NO: 455053 - DNA, 548 bp, Homo sapiens
gacccacgcgtcgcggacgcgtgggtcgacccacgcgtcgcggcggtgcgctctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 455054 - DNA, 500 bp, Homo sapiens
ctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 455055 - DNA, 1014 bp, Homo sapiens
taccatgtcgaccacatgcaaggctgggagaacccgggataccttctggccaaacgcccagtttagcgccctcgggtccagactactgcagctcctgctccaataccagcgccaaacctggcgtgatcttcacgagtgcaacaccaggtctctcgggttgcacaccccccactgtgggccgggggaccgctacacgccgccgcttgtgctgcagccatgtctctagtgatccctgaaaagttccagcatattttgcgagtactcaacaccaacatcgatgggcggcggaaaatagcctttgccatcactgccattaagtagagacagggtttcaccatgttggccaggctggttttgaactcctgccctcaatgtcatctgcccacttgggcctcccaaagtgctgggattacaggcgtgagccactgcgaccggcccaaagttaaccttctgtcgaacggtttatatctggaaaggtgggtgaggaaagggtgacctaggggattgcaaaatagattattgcagatcctacctttgtgagctttttgaatgaggctataaaggaatttaaaaatcagattcaacactaattccgaaacccctcacttcattcaggggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 455056 - DNA, 964 bp, Homo sapiens
  misc_feature (746)..(746): n is a, c, g, or t
  misc_feature (757)..(757): n is a, c, g, or t
  misc_feature (762)..(763): n is a, c, g, or t
  misc_feature (773)..(773): n is a, c, g, or t
  misc_feature (775)..(775): n is a, c, g, or t
  misc_feature (778)..(778): n is a, c, g, or t
  misc_feature (790)..(790): n is a, c, g, or t
  misc_feature (800)..(800): n is a, c, g, or t
  misc_feature (802)..(802): n is a, c, g, or t
  misc_feature (819)..(819): n is a, c, g, or t
  misc_feature (824)..(825): n is a, c, g, or t
taccatgtcgaccacatgcaaggctgggagaacccgggataccttctggccaaacgcccagtttagcgccctcgggtccagactactgcagctcctgctccaataccagcgccaaacctggcgtgatcttcacgagtgcaacaccaggtctctcgggttgcacaccccccactgtgggccgggggaccgctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaaaaaaaaaaaaaaaaaaacatcgnggcgaatttgntcccnnataagggatntntcnggaactaggggncatccctcananttgggaaaacccaggcncatgnntaaacatactgggtgtgtggtggacatcgacccattgatgtgtgtgaatgggagcaggttgtgcaagaggtgaatattgggtgaagtctaggcttaagatagatggacgaggaacgctggaaagcttggccttaggtgg

SEQ ID NO: 455057 - DNA, 795 bp, Homo sapiens
taccatgtcgaccacatgcaaggctgggagaacccgggataccttctggccaaacgcccagtttagcgccctcgggtccagactactgcagctcctgctccaataccagcgccaaacctggcgtgatcttcacgagtgcaacaccaggtctctcgggttgcacaccccccactgtgggccgggggaccgctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaaaaaaacactggcccgcgttttacaactcgtgactgggccctggggtaccccacttaatgcgcttgaggaaat

SEQ ID NO: 455058 - DNA, 857 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtgtgtactgaaatgagggcaggattagaggaagggtggagggtcctaacagaattgggcataggaggtcaggggataaaacatcccttgccccctcctctgaatccaggtcctagccaatggtctggacaacaagctccgtgaagacctggagcgactgaagaagattcgggcccatagagggctgcgtcacttctggggggtgagtggggggtctcatctccctgcctacctcgactcagcattcctcctactcgctcttctttttccccaaccttttgtttctgctgtgcatgacctgtgactcttctctttttacctgcagccttcgtgtccgaggccagcacaccaagaccactggccgccgtggccgcaccgtgggtgtgtccaagaagaaataagtctgtaggccttgtctgttaataaatagtttatataccta

SEQ ID NO: 455059 - DNA, 1232 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaacaaaaaaaaaaaaaaattcagaggacatcctactagacaggagtagcaggaaacaaaagggtacatggaaatgggcacatgggacgataagcatagtcccaggaccccaagttacctggtaccaaagggggtaagacactcgccgggtatacccataatagggagcacaggaataaagtgagcaggataaaagacccagggttaaaacccgtggagtcacacggaaacgcgcaagaaaccacgcaccaagcacacaagaaacaaaaacacacaccaagacgaaagcgacgcagacaaaaaccagcaacagaaacgaaaacaccaaaagaagacaaagagagacgaagagcacagaaagaaacaacacaaaaaaaagcaagaagcgaaggaacagaggagaaagaagacaggaacacaagaagaaaagagaaaagaaaacagaaagagaggagaaaaaagaacaaaaaaaaagaaagagaaagcggcgaaaaacgagaaaaggcagaaaacaagagaggaagagggagaaaaggaggaggaggaggaagaagcgggggccaggagcgagaagaagagaacacaccagcacacggaacaccaccacac

SEQ ID NO: 455060 - DNA, 1308 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaacaaaaaaaaaaaaaaaaaaaaagaaaaaaaaaaaaaaaaaaaagggggggggggcaaaaatctgggggggagcatcaaaggaaacccgcacttgttgtaccaacgaaaactgggcctccacaagagagggaccgacatagtaaactagaccaggcagcagaggagccgttgcatcaaccctcaggtgagggagggaaacacaccgcagcaagcgggacaacggaagagagggacaccaccccctgcggggcgggacacacactggggcgcacacaaccacgaaaagaaagacaaacaccagggggacaaaaaaaaaaaccacaaggcgacatacgcaggggaacccagccagctacgttatccgacgaacagacaaacaatggcccagaccgcgacattggaaaagaaacataatctgcccgcgagacgcagaacaacagccgccggacgcgaccaggcagggacaaggccacaccgagccaacagcacgaccaccacagccgacccaagacgcgacagcgtagcgcgaagcgcgtccgcaatgacgcgcatcacacacagacacaaccaaagccaccccagacacacacgaaacacacacgcgacccgccacaccagactccacagcgcacccgcagaccaccacgccgcgacgcaccgcccgcccggcaacaaca

SEQ ID NO: 455061 - DNA, 939 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaacaaaaaacgacacaaaacccaacagaacaccactaacaaacaaatcaacacaacagaaaaacagctaacacatagaacaacaacacaaaaaacaaaaaaccatcgtagtgcgggcgcctaaataaatcatttcatccgtgcgggggcgcacaacgtctgtcagcacacacatttagttttgatacgaagggcgcgcccatgattgggtgcgtgttttatacccagccaggacgacttggccgcatatataacacacgcacgtggcgccggcaaacccacctcattcgtgtcatattaggcgacagccacctc

SEQ ID NO: 455062 - DNA, 1025 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggggtgagtggggggtctcatctccctgcctacctcgactcagcattcctcctactcgctcttctttttccccaaccttttgtttctgctgtgcatgacctgtgactcttctctttttacctgcagccttcgtgtccgaggccagcacaccaagaccactggccgccgtggccgcaccgtgggtgtgtccaagaagaaataagtctgtaggccttgtctgttaataaatagtttatatacctaaaaaaacacacataacgcggtgccccgatccaacagttttcccctccagtaggaggcccaaaggttacggcgtaccacgcattacgtgctcaaactgtgccatcccctaatagggaagtccgaaatcaataccgcctagggcctgtagccggacagttcaaccaaacgtccgtgcacggggaaaaccctgcataccctgtgagcaatccgtgcgcgacagcgacccttaaacctatcctgggatacttttaccctcttcttcggcacacaacttacc

SEQ ID NO: 455063 - DNA, 924 bp, Homo sapiens
ctctagagcggccgcctactactactaaattcgcggccgcgtcgacacggctgcgagaagacgacagaaggggtcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccagcctagccaatggtctggacaaagcaagctcccgggaaaaactctgggaagcgatcggacaaaaatccgggcccatgcagaggcgcgggtgcacactcacgagggcgcctcgcggtgcccagaggcacagacacaccaaagacacagtggacgccgtgggagcgccaccgacgggacgatgtaccacaggacagaccactaacgtctgtacggccctggaccaggacaactaccagtagtgaatcctaccaacgaaacaaagaacgcacaacacacgcaccaccacagagacacccaaaagagaggcgaggccaccaaaacggacggagcacagcaacacacgcggaccaacagggcagacaagagcagctcgcccaaagaaacacaaagcaaaacccaagcacacacagggtgcgacaaacaacagagcggacaccacccaaaaacgaacagaaccaaagacaaccgcaaaaacccacaggaagaaccgaacaaaaagagcggcgaaca

SEQ ID NO: 455064 - DNA, 725 bp, Homo sapiens
taccatgtcgaccacatgcaaggctgggagaacccgggataccttctggccaaacgcccagtttagcgccctcgggtccagactactgcagctcctgctccaataccagcgccaaacctggcgtgatcttcacgagtgcaacaccaggtctctcgggttgcacaccccccactgtgggccgggggaccgctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 455065 - DNA, 983 bp, Homo sapiens
taccatgtcgaccacatgcaaggctgggagaacccgggataccttctggccaaacgcccagtttagcgccctcgggtccagactactgcagctcctgctccaataccagcgccaaacctggcgtgatcttcacgagtgcaacaccaggtctctcgggttgcacaccccccactgtgggccgggggaccgctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagtacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctaaaaaaaaaaaaaaaaaaaaaggggggcgcccttttttttttttttctgtacttccactattccactatcactgatcataagtgtaacatagagaccaatatcgacaaacaacaaccacagcatgcatgaacgcaatacccccatagatactaacaaaaaaactagacatcagaccacacaaatcatacctgacaacaacgaccacccgcacccataacggcagccctcaaaaacccccccatcatcatcctataacaa

SEQ ID NO: 455066 - DNA, 675 bp, Homo sapiens
taccatgtcgaccacatgcaaggctgggagaacccgggataccttctggccaaacgcccagtttagcgccctcgggtccagactactgcagctcctgctccaataccagcgccaaacctggcgtgatcttcacgagtgcaacaccaggtctctcgggttgcacaccccccactgtgggccgggggaccgctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccagggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 455067 - DNA, 655 bp, Homo sapiens
taccatgtcgaccacatgcaaggctgggagaacccgggataccttctggccaaacgcccagtttagcgccctcgggtccagactactgcagctcctgctccaataccagcgccaaacctggcgtgatcttcacgagtgcaacaccaggtctctcgggttgcacaccccccactgtgggccgggggaccgctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatcctacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccta

SEQ ID NO: 455068 - DNA, 429 bp, Homo sapiens
  misc_feature (330)..(330): n is a, c, g, or t
taccatgtcgaccacatgcaaggctgggagaacccgggataccttctggccaaacgcccagtttagcgccctcgggtccagactactgcagctcctgctccaataccagcgccaaacctggcgtgatcttcacgagtgcaacaccaggtctctcgggttgcacaccccccactgtgggccgggggaccgctacacgccgccgcttgtgctgcagccatgtctctagtgatccctgaaaagttccagcatattttgcgagtactcaacaccaacatcgatgggcggcggaaaatagcctttgccatcactgccattaaggtttggccgagntatgctcatgtggtttgaggaagcagacattacctaccagaggccggagacctacttaggttaggtgaccgtttatcccttttcagttccccgcatcca

SEQ ID NO: 455069 - DNA, 424 bp, Homo sapiens
tactagcctcgccagtgtcctagcctcgccagtgtcctagcctcgccacgtgtcctagcctcgccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggcgaggctaggacagcagtggcgaggctaggacagcagtggcgaggctaggacag

SEQ ID NO: 455070 - DNA, 398 bp, Homo sapiens
ttgcagatgttgagggtctcgggcctgagctgcgcctcatgctgtacttccctcagggtcggagtgtgccacctcgtgcctggaccacaacagcgagtccatcatcctgccaatgaacgtgaccgtgcgtgacatcccccactggctgaaccccacacgggtagaggtgagtgaccagggacatctacccacctgcagctaagggggagggaaatgatattgttgagcacttgctatgtcccggttctgagttcattctttcacacatattacctcatttaatcatcacacctgccctgtgggtgtgtgttgcagggaggtggggtagagtcgggaggagacttattcacaatcatttctctagtccttaattatttaatactttctctctgtcaggt

SEQ ID NO: 455071 - DNA, 13828 bp, Homo sapiens
  misc_feature (13814)..(13814): n is a, c, g, or t
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgctggcatggattgggtccgngctcgattctatct

SEQ ID NO: 455072 - DNA, 13944 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgctaaaaccacaccaacacactcccaaaaccaaccttctggcgcccgccccgcgcctccaaaaactctctacaaaccatctcgttggggccccgggccccactggtcgtacggcacctgcgcccacacgggtttcccagaggaacaccggc

SEQ ID NO: 455073 - DNA, 13743 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455074 - DNA, 10400 bp, Homo sapiens
cgtccctgccccccgcggcaggagcttgcttcgttgccctggctggagtgcagtgaaagtgataatggctcactgcaaccttgaacctctggggctcaagcgaccctatcagcatcagcctacgcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455075 - DNA, 12416 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgcctatgtggatggggtatgtcgatatgtttatggtacatctctaggaggggaagggccatatctgacttcttggaaactcaggtacatggtagccatgtaataatgaatgggttaaggatgtaattacttccctggggccctagaaaccccattttggcacattcaatgtggccaatcaaggggtaccgagctc

SEQ ID NO: 455076 - DNA, 11720 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactatgtgctggggatcctctgatacagccccg

SEQ ID NO: 455077 - DNA, 13899 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctagaccccaagaaggagagagactgagtaagagccatttccccgttgtacatgtcaccatctgagacccaaagagaggcactgagagaccccaagtcacatggcaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455078 - DNA, 13678 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggagtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455079 - DNA, 11567 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattccttttgtagaactctggacgttgaggattcattatgctgtggttaactttaaatatttttgaattccaaatatctgaattaatgagccttgtctttacaaatatgtgccattgtgcaacatcggtggattttctaaaaataatgtaaatgtcttctattaaatgttgagtgcaataaaatacagaagaattcaaaaaaaaa

SEQ ID NO: 455080 - DNA, 13119 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455081 - DNA, 13502 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455082 - DNA, 12609 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455083 - DNA, 12542 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455084 - DNA, 8375 bp, Homo sapiens
gacagagtgcggagaagctcagtggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455085 - DNA, 8544 bp, Homo sapiens
gctgctggacagccgctgaccaggtacatcttctgtcttctgtttctgctgctggggagcattagactgtcctatggactctcctaagcctcctagaggcagttggctgatggtcttcaacagattgtctttctgtcctctccactctgcctctcctgttttgacctctgtcctctacaccattgcccagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455086 - DNA, 9739 bp, Homo sapiens
  misc_feature (9313)..(9313): n is a, c, g, or t
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaaaacaaggttgtttaacacaagttttttcctttacttgaaatttggttcatcgggggaaaaggggcccccaattcccaaggangaaccttacctggggaaatttgtccgagacttttgcgatttattattcccttaatccttaatcctaaatccttttcgcctttaaaggccccccttttccaggggctttaaaggaaggttaaaggcggcgtttcccggaattccccctttggaaggaaacccgttttggacctggggtttcattgggcgccgcctttcccccttttggggacacagcgcgggaacgcgaaaactttactttaccaatttttcccttggggcgggacggaaacacgcaattctttcttatacaggaagcaggatacacgacttggtttcttccaaaggaagtgtgtcccaatccaaggaaaacggggaaaggcggccaaaaaaggaaagatttcccaaccaaggtcccctttccaagggcaaacccacaaaacaaaac

SEQ ID NO: 455087 - DNA, 7962 bp, Homo sapiens
gatcctttccataatgtgtgcccaggatggccgctgttaagagggagcttgtgttcctgtgacctgtgacccacctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455088 - DNA, 7248 bp, Homo sapiens
agctgactctatgaggatccccaattagctggcacacaggcaaagatcagagccacgatctgcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455089 - DNA, 6649 bp, Homo sapiens
  misc_feature (17)..(17): n is a, c, g, or t
cacaggaattagcttgncacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455090 - DNA, 6444 bp, Homo sapiens
tactagcctcgccagtgtcctagcctcgccagtgtcctagcctcgccacgtgtcctagcctcgcatttgatcactgtgtcctggaggtggtcgtttttgaggaggctaggacattggggagggtaggactagcctcgccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455091 - DNA, 6370 bp, Homo sapiens
tactagcctcgccagtgtcctagcctcgccagtgtcctagcctcgccacgtgtcctagcctcgccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455092 - DNA, 6284 bp, Homo sapiens
ggaccacggttaggtacagctacgggtgaggacagtgatgtctcccaggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455093 - DNA, 6574 bp, Homo sapiens
agtgactgttaagtccagtctaactgacctagagatggagaactaagtgcactggaggggaagcccatagacaaagagatgcagccagaatctactgatttttttcattcatttatggacacgctcatacattcgttcatttgattgtccatttgttcatttacttattcaataaacatcgactatgcacctccaagcagatactcttcaaacactaggaatacgaagtgggaaatgcctaggcttttaaaaagcttaccctggaaagaagccagaaactcagtggctgataacaaaaagcaaataattaataataataataataataactgatatgattcactcatagcaggtcccagaaatcaaggaaaaaagctaagggaaaaagggcttatcttagaagacatccaggaggggtgtcagatctgagcctctggatgagggggctctcttagatgctttctcacatgtctttggctctgcttggggcctgtcttcttgggccttcatcttttagatgctctacccactccaacatttgtctcaaagggcctctccacctttctgaactttggtcttcccatcggtcaaaaaaagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455094 - DNA, 5932 bp, Homo sapiens
ttcctccttctgtctccctttccagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455095 - DNA, 5537 bp, Homo sapiens
tgcatacagttgaccgtgctggtgtgtgatcgaagtgactgcccgtcgctaaaatcagatatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455096 - DNA, 4231 bp, Homo sapiens
tctttgctcttttggggtctttgctcttttggggtctttgctctttcggggtctttgctcttttggggtctttgcgggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455097 - DNA, 8201 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagtcccaggggcaggacctccaagaacagctggctgaggggtgtagactggcacagcaccttgtccaaaagctcagcccagaaaatgacaacgatg

SEQ ID NO: 455098 - DNA, 7911 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcgctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455099 - DNA, 7850 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggcgaggctaggacagcagtggcgaggctaggacagcagtggcgaggctaggacag

SEQ ID NO: 455100 - DNA, 3563 bp, Homo sapiens
ccctgttgcatctatgacaatctttcccttccttaacacccaattcaccatcaaaactcatttcccaaggactgtatttccttaaaaggttgttggcacagaatctgggggtaatgcaaatcctttgggtaggtagttaagattgtggcttggaaaggcttccctaaatagggcttagaggactgtccacctcatctttcatattttgctgaattcactctgtgagtctgaagatactatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455101 - DNA, 7323 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcccgtcgctctgccaatttggcagagcgacgggacggtgacgaggctggtacacctacacagacctagtgtgtgctgctggagcaaaccgacctagagcagtaggccctgggctccctctgccagcgcgctggt

SEQ ID NO: 455102 - DNA, 8115 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctagaccccaagaaggagagagactgagtaagagccatttccccgttgtacatgtcaccatctgagacccaaagagaggcactgagagaccccaagtcacatggcaggtcaggaattactagttagattttcagcgtcatagcctattgctttttaccctataaccgggagtgttcatgaccctccaccccaagtggggactgtatcaccagtacaacctctggagaagtttccaatgagaataggaataggaatattgtaggagtagggaggcagttgaggagtcaggttctaccatgggaggacctccctgagtgcagggccaagggggaggacaagggctggacttggccacttgtaccacccctttgaatacccacatgcaccgtggtccagaggagagagcctgaatccagagctgacagctgaggtttggatcctgtccccaccactcactcaccttgagaaggtgagcaatcttcctgtcctcacagcacatcacttagaggctcacttgcttcacatacacagcaaggacaatgatatccaccttagagtcagagtgcactattatttgacactgttgtaaccatgcctagcacaagatcgggccctaagaattcctattgtcgctaagaatttcctatgacaccttcacacttccagtctaccctggagagctctgggcagcctggatactccaagtatttggaatttttggccactactgaagcctggacttcaaagttgtgcccacaccattctgcagagaacgcctttcaaagacctgtatgaagcaagccaggcaaggggtcatttcagggtcagataaaagccaagggagcagggaagattttcttgttttgtttttatgcttgtttatttagttccttttaaaggcaaggggaacctatgaataaggaagagaaagaaaacccctctggacttagcaggattcctgggaaatttccctaagtgagaaacaaatattttcatagttgtcgttgcacagcccagggctctgaggagaggttttttcagcagagtggggaaaagtctggttccacaggagctctttggatcctggtactgatgcctgaggcttttctgtttttcccctccacccccaccatcaccatcttcctcagtctatgacatcccagcattctccgaggcagcttcacctctggaactgagaagggcacctgcttcaggcttccacatgggagatttctccttacatagcaagcccgccaggacatggttaggattataccattttttggatgtgaaaactgagttttaggggctttctggagtcccattattaggaaggggctacaccagcatttaaactcaggtccacccaacaccaaagccaacttctgttttgctaattccatcttgccacagccttcctttccttctgtcccttgtgtatcttttctccctggccctctcccttccttcttggagaatgggaacctgctggctgcattaaaaaaaaaaa

SEQ ID NO: 455103 - DNA, 6476 bp, Homo sapiens
  misc_feature (6468)..(6468): n is a, c, g, or t
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcaaggaattcccacaccagcacgatcccggatcctctagancacttcac

SEQ ID NO: 455104 - DNA, 6413 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtagttcaacttctacaccatccttaaagaaaatcatatatggggtcacaccatcctcacggtagtccaatagagcaaccatgccatctggattcatgttttcaccaataaagaactggtagtttttgaaattagcaaggatgtgcttgatttgttctgcagcccctgtcataaaaggttttactctttctggtctctgttcttctacta

SEQ ID NO: 455105 - DNA, 3360 bp, Homo sapiens
tactgatgtgattgcagtgagcccaccattgaataactcttactcgagcttttcccgtctaaatctagtccgttatcctgctttctagtcttcactctccatcagtcatctatatgcatactactccgagctaaggacagattctcatggaggtcatgactttgttagtcattccgtactcacagaagttgaattctaggcatcttcgtgaattcataggacgctcacgctcgagatacatactttcagtgtacaagggacccattgggttgcgtaagcatagattatatgagtatgtgcgctaagggtatatcaggcaaaagagaggctacgtatgattggtgagccagtcctcgggcccacttggaacggtatctaataatagggtctgagcaagcctatagtggagaggacgggctcagtcctcacaatgtctggtgcgagagctaatttggtatccctagattgacatttgacttccatggagaattaatcgtacgtcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455106 - DNA, 6335 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatgtaagtgcattctctgaatagggagtttattaagtgggtgggttgtggaggaacgtgaggtgggtcagagaggcctggacagggggaaggttcatcacagtcaagactcactctatggattgtaacccatcattgggtgtagatttgtcttaacatggcagagttgatatcatgggaagagcaatagggaaggaaccattagacctggatttagtgacaaatctgatgtgtgaccttaagcctcataagcctttcttaatcttagtcattccaatagtaaatgaaggaggttggatgagagtagcagtgagaaaatcatttattactaatgaaagtagaagaactgaagtttgctaatgattttctttttatattaaattgaagacaattt

SEQ ID NO: 455107 - DNA, 5087 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaaccctcggaagacgtgatagaggcccaggctgtgaccaatctcatggggccattcaacgcctccg

SEQ ID NO: 455108 - DNA, 4630 bp, Homo sapiens
  misc_feature (4616)..(4616): n is a, c, g, or t
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactggtacagcggggggatnctctataacgagca

SEQ ID NO: 455109 - DNA, 778 bp, Homo sapiens
aacagtgtacgagtcgagccggacccaatccattccagcgtagatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455110 - DNA, 709 bp, Homo sapiens
aacagtgtacgagtcgagccggacccaatccattccagcgtaggtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455111 - DNA, 775 bp, Homo sapiens
aacagtgtacgagtcgagccggacccaatccattccagcgtagaccagtgaggacgagctactctcttctaaagcaaaggcagtgagaaagactcggaattttatcattgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455112 - DNA, 3797 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaaaaaaaaaaaaatttttggggggttgggctaaaaagtttttttaaaacaatttcgtttgtgggagccggggggccccatgtagtggttactgtgaacagtgtgtccaatagcgcgtggttttcccaagaggaaaaatcggtgcgtcagaggaaagcatagtcgccgtgggaattctctcccccgaataaaaaaaaggcccgggggaataacaccacgcgtttttctgtacaacaaattcccaagaatggggatgtttggaagggctacaatcacggggaattattaattcacaggggggggagttcccccaaggggagaacgccggaatatttacaaaaatttaggccccgccagtcggcgggggaagggcaggactatcgacacacgaaaatggagcaaacgcacaacacgaagacacagataagtgagcaaagaagctagcggaaaaggcggaaaacgcgggataggcggcggcagaaggggatagcacggagaggaaagaagagccacacaacagtcgaggagcgcaagccaggaggacgacagcaccagccaggctgggccgcgagggactgcagacggtggcagaacaaaggcggtgggaaacggcagcgcggacgatcactggtcgacacgaccgggagggaggagacgggaggaggagagggagggagacagaagtggggagagcgtcagagcggggggagcag

SEQ ID NO: 455113 - DNA, 271 bp, Homo sapiens
cttcttcaacactccttacaacaacttcatgagctatgcaggtagggccctacactctgtagggtgaacaggtctggatgtcagatgtgggatccaatcctggctcaggggaaccttgaacaagctacttaccatttctaaggatggaaggcctagctctgccacttatccacctaatgtctttcggtcattctctttctgggtttcacttttctcaagaaaatggaattgttggactagcatctccatgatccttcctaaatgtgcagca

SEQ ID NO: 455114 - DNA, 170 bp, Homo sapiens
ccattcatcccattctgttctgtgagaagctagaaggatttgttaataatattagctttgggtcaaacagaacaaactttaagtttcagcttggctgcctaatggcaatgtgatctcagacaaatgactttacttctctgcacttcattttttttttaagccacaagagg

SEQ ID NO: 455115 - DNA, 392 bp, Homo sapiens
tcacaaatggaaaaactgaggctattcaaggtttaaatcttgataacatacaaagctttcaagtggcaagatttgaactctggtttgtctgttgccataacttgtgctcttaatgagaaactttaatcgctgcctctagagtcatcttcaccctagccagcacccctttctgtcctcagtctcaagccccctgaaatcttggagaaagaggctcttagcctttatcttccaactgagcatagctgtcctgtgaggagactccttcttcccctcgtttctttcctccccagctgcgtgcacttcgcatgtgagaaaactgactgtccagagctggctgtggagaatgcttatctcaattgctccagcagcgaccgctaccacggtgcccagtg

SEQ ID NO: 455116 - DNA, 419 bp, Homo sapiens
acgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggtatcaagaacgccttccccagctcagccttcctttgtctatgggaaacctagaagctgcatccaggccctctttctgggtctcaaacaccaagggtgggatgggttttatctatgctcctgacttcttcctactaattgtatttatgtaaactgccctgctatgcagataagaaagaaaaaagagtgtatggataattatgacagtgaagccctttccaagaccttggaaatct

SEQ ID NO: 455117 - DNA, 344 bp, Homo sapiens
tctgggccacacaacggactctgtgacactggagtggttcccacctatagatggccatttctttgaaaggtgagtgtgccctgtgtagtgttgatccctctctctctctcctgccaagaagaaggaaacttggaagggaagcagacttggagagggattttactgcatttcttgttcttgttcaaaaggtatctccaccacctagcatgttgtaaatttgggatcagggaataaataaatggtcattaatagaaacaaataaataacaataaatatttttaagtgaatgggtacttgaattcactttgttattagaaacttggaaacctcttttgctacagacc

SEQ ID NO: 455118 - DNA, 12380 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactgtgcgggcctctcaggctgtggcaggtgcgcggtgctcccagctcatcgtggaattccagcct

SEQ ID NO: 455119 - DNA, 11773 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaacgaccaacacaaaaaaaaacaaacaaaacaccttgtgggccccctcaaaaaggtttttaaaaccctttccgtggggccccgggggcccataggtgtacggacaccgcgggccacacggggccccgaagaaagccccggggacacagaccagggcgttgagattccccccaaataaaaacgcccggggggaacccagaggtttggacaaccccagaagggaaccaagagagcaaaaggggcccatcaaggggactcaagaagcgatataaactg

SEQ ID NO: 455120 - DNA, 9753 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacagatgctaggagaacacttggagctggcctcctgacacagtcgacacttgcttctgaggtcacagtgcctactccggaactt

SEQ ID NO: 455121 - DNA, 8718 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaagtatgtagtcctacatacttccggggggaggtaagtatattcttcatatacaggtaagagtgaaatgatagaagaatgttcctcctctccttttcttcctggaccacagatcaaatatttctcagatcttttacgctgaattggagtcacctggacaggtatgatcttacatataaaactattttaaatcacatgcccaaattttactaa

SEQ ID NO: 455122 - DNA, 8049 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagaggtgagtgaccagggacatctacccacctgcagctaagggggagggaaatgatattgttgagcacttgctatgtcccggttctgagttcattctttcacacatattacctcatttaatcatcacacctgccctgtgggtgtgtgttgcagggaggtggggtagagtcgggaggagacttattcacaatcatttctctagtccttaattatttaatactttctctctgtcaggt

SEQ ID NO: 455123 - DNA, 7719 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaagtaagtggggttggaaatgcaaacttatggtctctgggaggacaagagttaggttcaaatgcctgactggacggaagcactcatttcttcactggaggtaatgactgccattcatcccattctgttctgtgagaagctagaaggatttgttaataatattagctttgggtcaaacagggacttaccagtcacgacgctttgtctacacaatgccgaggtcatttcgcacaaatcattttacttgtctgcacttaattattatcgcaacacacaagatacacatgataataacagtagtatataaggttgaattatgtgagccgaacagtgta

SEQ ID NO: 455124 - DNA, 3254 bp, Homo sapiens
atcggccggccagattttctatgcacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455125 - DNA, 6455 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcaagcaccagcacgagtgggatcctcta

SEQ ID NO: 455126 - DNA, 6710 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattggtacgtctttttcatttcttgtggccttcatgaagaaatgaacggtgcagaatggttggtcaatgataatgccaacaatagttatgactaaatgatgattcactcctttgtattacacctgtttattgagtgcctcctacatgccaggcactgttttcaatatcgggaaatacagcagtgaaaaaacaaacaaacaaagcaatccctcaagagcttaagctctcatagatgatgccaatgacgggtaacttcttttgatcaagctttaccttacaaacatccctgcttttcttcacactaactgtccaggatgggtattactggagatgttttaaggcttttattcctacttcagagataagaaaaaatcaaacgccagaaaaatttcaaaagttgtccagagttatacaggtcaaaagtgattaaagacagaatcaggacttgaacctgattttgtctgattctcaagcacgtgctcaactcattttgctttgcaacctccagccgtgatgcaggaaccaccaaggtcccctctgcagactcag

SEQ ID NO: 455127 - DNA, 5698 bp, Homo sapiens
  misc_feature (5639)..(5639): n is a, c, g, or t
  misc_feature (5661)..(5661): n is a, c, g, or t
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctgacattgggacttgctcatgctggacctatgactgcatgctnaatgtgctgcatggaaaaattnctgggctaaagctttggagccatgcataattggcggg

SEQ ID NO: 455128 - DNA, 13662 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagtgatatggatttgttttcccatactgtctgagacagaaatatttgccagctgttgattactatagct

SEQ ID NO: 455129 - DNA, 13887 bp, Homo sapiens
  misc_feature (13858)..(13858): n is a, c, g, or t
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgctaaaaaaaaaaaaaaaaaaaaaaacaaaaaaaaaaaaaaaaaaaaaaaaaaaaaaaaaaaaanaaaaaaaaaaaaaaaaaaaaaaaaaaaaa

SEQ ID NO: 455130 - DNA, 13796 bp, Homo sapiens
ctgtccaggttgagtgagggtgtccaggatgaggaatgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgtgtgagggtgtccagggtgcagagtgaggtgtccagggtgaggagtgacggtgtctggggtgagtgagggtgtccagggtgaggagtgagggtgtcagggtgagtgagggtgtccagggttgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacacgcgagccctaagattgaagcatagcccgggagggttcttagctttgcccaggaaggaactcaaggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatcgtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggcctcgagaagggcggagtcctgcttttccgtaactacttcctgctgagtttatggcacgtaggccctgcctggcactggaggacgtaaaaatttctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagcaccccagggtgctgctagtcctattgccaccctgattcctgccagaaataagtaagcaagcaacaggacaatgaactccatgttgcccagatcccactgagagtgaacgtgcagtcatgcccataaccgacacacatcccagtccatgtgggtcagtccttcatcaccctccctgccttctgacaacagcagactccagccattccattatcattcacagcccaacccaagcagtcagtggctgaagaaagagaatcaggtatactctatgtccacatataccttcctgccacagggcttcaccaactggcaggattccccccagcccccaactcctcctcatcccttgttcccaggcgggtcaattggagagtgagcagagatagatggcttgcagaagggtatgcaagatggggagactccaccagaccttagggagagaatggcatctttctccaccttttaagagagacagagcctccctgaggtctcaaagatttttcagggcaacacaagaaacgtttccaagcctcagctgcaggtgttcacctttccactctggggtgtgaggagatggtaagctgaggacaagtgtgttccagatgcaggccaactctgttctccaacagtttgaaccaacttggccttggggttccaagggtaggatgaagggtgtcacggcaggacggggcctggcgtgaggcaacagcaagcagagcgaggacacaacagtggcagcagtgtacagacacaggacgtcagcttcaaacgatgcaacagcagggatatcttgggcacggctctgattcgagccactcccaactctcttgcctccaggatggaggcactgtacatgcaacagtccagagaaagattctagccagtccaagcccaggcacatccagagaaggtgggagctcttcgggttgactccaccgaggaaaacaggcatttgggtatttcagattcccgctccacaataaggcaacttttaaaaaaatattatttccaaaaacaaaacaaaaattccagggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtgaaggggggctcgcccaagaagggtgaagaagcgaagaaagtcgaggcgccgaggctcccaaagctggcagctccgggtggcggtgcaggggcgaaggggggggcggggggaacgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttatctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgacctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagactcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattacgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaagaaaaagaagaaagacacaaagaaaataatctaaacaccaaaaactaaacacaattccaatcctttttctgtacctcacgcgcataaatttggctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgct

SEQ ID NO: 455131 - DNA, 7801 bp, Homo sapiens
cattagggaaaacataaagtggctgaatttacaaattattggtatccccaagcacaaagaaaggattagaaaacctatttaacaaagtaatgatgaaaactctcaagatctagcaagacatagagacattcagatataggagacacaatgatccctaggaagatacagtgcaaaaaaggtcttctcaacaaggcattataatcagactctctaaagtcaaagataagagtgaatcctaaaaatagcaagaaaaaagcatgtagctacctataaaggaaaccccatcaaactaacagtagatttttcagcagaaaccttacagctcgtgccgaattcggcacgaggtttgtcgcagcaagaacaaacagcattccttccagcaaatcaagtgcctgttttacaacagaacacttcagttgctgcaaaacaaccccagacttctgtggtacagaatcaacaacagatatcacaacagggacctatatatgatgaagtggaattggatgcattggctgaaattgagcgaatagagagagaatcagctattgaaagggagcgcttctcaaaagaagttcaagataaagataagcctttgaaaaaaagaaaacaagattcttacccacaggaggctgggggtgctacaggaggtaatagaccagcttctcaggagacgggttctacgggaaatgggtcaaggccagcattaatggttagcattgatcttcatcaggcaggaagagtggactctcaggcttctataactcaggattcagactccataaaaaagcctgaagaaatcaaacaatgtaatgatgcacctgtttctgttcttcaggaagatattgttggaagtcttaaatctacaccagaaaaccatcctgagacacctaaaaaaaagtctgatcctgagctttcaaagagtgaaatgaaacaaagtgaaagtagattagcagaatctaaaccaaatgaaaaccgattggtggagacaaaatcaagtgaaaataagttagaaactaaagttgagacccaaacagaagaacttaaacagaatgagagcagaacaactgaatgcaaacaaaacgagagcaccatagttgagcctaaacaaaatgaaaatagactgtctgacacaaaaccaaatgacaacaaacaaaataatggcagatcagaaacaacaaaatcaaggcctgaaaccccaaagcaaaagggtgaaagccggcctgagactccaaaacaaaagagtgatgggcatcctgaaaccccaaaacagaagggtgatggaaggcctgaaactccaaagcaaaaaggtgagagccgccctgaaactccaaagcaaaaaaatgaagggcgacctgaaacaccaaaacacaggcatgacaataggagggattctggaaagccatctacagagaaaaaacctgaagtgtctaaacataaacaagatactaaatctgactcacctcggttaaaatcagaacgagctgaagccttaaagcagagacctgatgggcgatctgtttctgagtcactaagacgtgaccatgataataaacaaaaatcagatgacaggggtgaatcagagcgacatcgaggggatcagtctagggttcgaagaccagaaacattgagatcctctagtagaaatgaacatggcattaaatctgatagttcaaaaactgataaactagaacgaaaacacaggcatgaatcaggggactcaagggaaagaccatcttctggggaacaaaaatcaagacctgacagtcctcgtgttaaacaaggagattctaataaatcaagatctgataaacttggttttaaatcaccaactagtaaagatgacaaaaggacagagggtaacaagagtaaagtagacactaataaagcacaccctgacaataaggcagaatttccaagttatttgttggggggcaggtctggtgcgttgaaaaattttgtcattccgaaaatcaagagggataaagatggcaatgttactcaggagacaaagaaaatggaaatgaaaggagagccgaaagacaaagtagaaaaaataggattagttgaagatctaaataaaggagctaagcctgtagttgtgctacaaaaactgtctttggatgatgttcagaaacttattaaagatagagaggacaaatcaagaagttcccttaaacctatcaagaataaaccatcaaagtcaaataaaggtagtatagatcaatcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatcctctaggaaacgacataaaaaagatgatgataaagcttgggaatatgaagagcgtgacagaagaagctctggggatcataggagaagtggccactctcatgaaggaagaaggagttcaggtggtggtcgttatcgaaaccgaagtccgtcagattctgacatggaagattattctcctcctcccagccttagtgaggttgctaggaaaatgaagaaaaaagaaaaacagaagaaaaggaaagcatatgaaccaaaactaacacctgaagaaatgatggactcttcaacttttaagagattcacagcctcaatagagaatattttggataatttggaagatatggattttactgcgtttggtgatgatgatgaaattcctcaggaactgctcttaggaaaacatcagcttaatgaacttggcagtgaatctgctaaaataaaagcaatgggtataatggataagctttcaactgacaaaactgtgaaagtcttaaatatcttggagaagaatattcaggatgggtcaaagctttccactttgttaaatcataataacgatactgaagaagaagaaaggttatggagagaccttattatggagagagttacaaaatcagcggatgcttgtcttacaactatcaacattatgacatcccctaacatgccaaaagctgtgtacattgaggatgtaattgaaagagttatacagtacactaaatttcatttgcagaatacactttatcctcagtatgatcctgtttacagattagatcctcatggaggaggcttattaagttcaaaagcaaaacgggctaaatgttctacccataagcagagagtaatagtaatgctttataacaaagtttgtgacattgttagcagcttatcagaattgctagagatacaacttcttacagacacaacaattcttcaggtttcatctatgggaataacaccattttttgtggaaaatgtcagtgaactacagttgtgtgccattaagttagtcactgcagtattctcaagatatgaaaaacataggcagttaattttggaagaaatttttacttcacttgcaagattaccaaccagcaagaggagtttaaggaacttcaggttaaacagtagtgatatggatggagaacctatgtatattcagatggttacagcactggttttacaacttattcagtgtgtggtacacttaccatcatcagagaaggactctaatgcagaagaagattcaaataaaaaaattgaccaggatgttgtcattactaactcttatgaaacagctatgcgaacagcccaaaacttcctctccatcttccttaaaaaatgtggtagtaagcaaggtgaagaagattacagaccactgtttgaaaattttgttcaagaccttctttcaacagtcaataagcctgaatggccagctgctgaactactccttagtttgttagggagactgttggttcatcagttcagtaacaagtcaacagagatggctttaagagtggcatctcttgattaccttggaactgttgctgcacggctaagaaaagatgctgttacaagcaaaatggatcaaggatctatagaacgcattttaaaacaggtttcaggaggggaagatgaaatccaacaattacaaaaagcattgcttgattacttggatgaaaacactgagactgatccttcactagtgttttctcgtaaattctatatagcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagatgaactctgatactgtggactatgatgatgcttgcttgattgttcgatacttggcctccatgaggccgtttgcccagagctttgatatttatttgacacagatcctacgagttcttggtgaaaatgcaattgctgttcgaacaaaagccatgaagtgtttgtctgaggttgttgctgtagaccccagtattctagcaaggcttgatatgcaacgaggtgttcatggacgattgatggataattcgactagtgtccgagaagcagcagtagaattactaggtcgatttgtcctttgtcgacctcagcttgctgaacagtattatgatatgctgattgaaagaatattggatactggtatcagtgtcaggaaaagagtaataaagattctcagagacatttgtattgaacaaccaacatttccaaaaatcacagaaatgtgtgtaaaaatgattcgcagagtcaatgatgaagagggcattaagaaattagtaaatgaaacattccagaaactctggtttactccaactccacacaatgacaaagaagcaatgacaaggaaaattttaaacattaccgatgtggttgcagcatgcagagatactggatatgactggtttgagcaactgcttcaaaacttgttgaagtccgaagaggattcctcatataaacctgtgaagaaagcttgtactcaacttgttgataacctagttgagcacattcttaaatatgaggaatctctagctgactctgacaataaaggtgtgaattctggaagattggtagcttgcataaccactttgttcttattcagcaaaataagaccccagctcatggttaaacatgcaatgactatgcaaccataccttaccactaaatgtagtacgcaaaatgatttcatggttatctgcaatgttgcaaaaatcctagagctagttgtaccactgatggagcatccaagtgaaacttttcttgccactattgaggaagatctaatgaagctcatcatcaaatatggcatgactgtagtgcaacattgtgtgagctgtcttggagctgttgtaaataaagtgacacaaaattttaaatttgtgtgggcttgtttcaatagatactatggtgccatttcaaaattaaaaagtcaacaccaagaggacccaaataacacttcacttctaacaaacaaaccagcacttcttagatcccttttcaccgttggagcactatgtcggcattttgattttgatctggaagattttaaaggcaacagcaaggttaacataaaagataaagtacttgaactattgatgtattttacaaaacactcagatgaagaagtacaaacaaaagctatcattggtctaggatttgcctttattcagcatccaagtctaatgttcgagcaagaagtgaagaatctatataataatattttatctgataagaactcctcagtcaatttaaaaatacaagtgttaaaaaacctccagacctacctacaagaagaagatacacgtatgcagcaggcagatagagactggaagaaagttgcaaaacaggaagacttaaaagaaatgggtgatgtttcctcagggatgagtagttccatcatgcagctttatctcaaacaggtgcttgaggcattttttcacacccagtcaagtgtacgccactttgccctaaatgtcattgcattgactctaaatcaaggtcttattcatccagttcagtgtgtgccatatttaattgctatgggcacagacccagaacctgctatgcggaacaaggctgatcagcaacttgtggaaatagacaaaaaatatgctggattcattcatatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcaaaaacagacgtgactatgctcttgtatatagcagacaatctagcctgttttccataccagacacaggaagagccgttgtttataatgcatcatatagacattacactctcagtttctggtagtaacctactgcagtcattcaaggagtctatggtaaaggacaaaaggaaagagagaaaatcatcacctagtaaggaaaatgagtcaagcgacagtgaagaagaagtttccaggcctcggaagtcacggaaacgtgtagattcagattcagattcagattcagaagacgatataaattcagtgatgaaatgtttgccagaaaattcagctcctttaatcgaatttgcaaatgtgtcccagggtattttattacttctcatgttaaaacaacatttgaagaatctttgtggattttctgatagtaaaattcagaagtactctccatctgaatctgcaaaagtatatgataaagcgataaaccgaaaaacaggagttcattttcatccaaaacaaacactggacttcctgcggagtgacatggctaattccaaaatcacagaagaggtgaaaaggagtatagtaaaacagtatctagatttcaaacttctcatggaacatctggaccctgatgaagaagaagaagaaggggaggtttcagctagcacaaatgctcggaacaaagcaattacctcactgcttggaggaggcagccctaaaaataatacagcagcagagacagaagatgatgaaagtgatggggaggatagaggaggaggcacttcagggtcattgagaaggtcaaaacgaaattcagactctacggagttggcagcacagatgaatgaaagtgttgacgtcatggatgtcatcgctatttgctgtccaaagtacaaagatcgaccacaaattgcaagagtagtgcagaaaaccagcagtggcttcagtgttcagtggatggcaggctcctacagtggctcctggactgaggctaagcgccgtgatggccgcaaactggtgccttgggtagacactattaaagagtcagacattatttacaaaaaaattgctctaacgagtgctaataagctgactaataaagttgttcagactttacgatccctgtatgccgccaaggatgggacttccagctaatgaatttgtacatgcagccaaatttacaggaatttttttaaaaggcagaaaaacttgaaataccaacattctggcaaaaaaaaatcagttttatgaagagtaagtggaacctgggatgcaggaacaaaagaaggaaatgttgggcaaacatttttgtgggagctcccttcgctgttgtgcagcagaaacagattctcagttcatttttactcccactgtattatagtttaacaaaaattgtttatatcttggaaaaaaaactttctgtttaaaaaaaataaacaagtgaatgttgga

SEQ ID NO: 455132 - DNA, 402 bp, Homo sapiens
cagcatcggtatcaagtcccattgttgcaggtggtttgagaaacatacatgataataaagtttctggtccgttgtctggcaattcagctaatcatcatgctgataatcctagacatggttcaagtgaggactacctacacatggtgcacaggctaagtagtgacgtatgtaatatattatcattaaggtgataaaatagttctaatatttgtcatataacctagtatttccatttcaaaatttgaatgatacctaccgtatatcattatactgggtactgagtacaacatggctcctgcacatacagagcttagtctagagcaggattggtcaagtgtgaccagtagcctgaaccacaaagtgagaatggtttttacatttatacagagttatttaaaaaaa

SEQ ID NO: 455133 - DNA, 8664 bp, Homo sapiens
cattagggaaaacataaagtggctgaatttacaaattattggtatccccaagcacaaagaaaggattagaaaacctatttaacaaagtaatgatgaaaactctcaagatctagcaagacatagagacattcagatataggagacacaatgatccctaggaagatacagtgcaaaaaaggtcttctcaacaaggcattataatcagactctctaaagtcaaagataagagtgaatcctaaaaatagcaagaaaaaagcatgtagctacctataaaggaaaccccatcaaactaacagtagatttttcagcagaaaccttacagctcgtgccgaattcggcacgaggtttgtcgcagcaagaacaaacagcattccttccagcaaatcaagtgcctgttttacaacagaacacttcagttgctgcaaaacaaccccagacttctgtggtacagaatcaacaacagatatcacaacagggacctatatatgatgaagtggaattggatgcattggctgaaattgagcgaatagagagagaatcagctattgaaagggagcgcttctcaaaagaagttcaagataaagataagcctttgaaaaaaagaaaacaagattcttacccacaggaggctgggggtgctacaggaggtaatagaccagcttctcaggagacgggttctacgggaaatgggtcaaggccagcattaatggttagcattgatcttcatcaggcaggaagagtggactctcaggcttctataactcaggattcagactccataaaaaagcctgaagaaatcaaacaatgtaatgatgcacctgtttctgttcttcaggaagatattgttggaagtcttaaatctacaccagaaaaccatcctgagacacctaaaaaaaagtctgatcctgagctttcaaagagtgaaatgaaacaaagtgaaagtagattagcagaatctaaaccaaatgaaaaccgattggtggagacaaaatcaagtgaaaataagttagaaactaaagttgagacccaaacagaagaacttaaacagaatgagagcagaacaactgaatgcaaacaaaacgagagcaccatagttgagcctaaacaaaatgaaaatagactgtctgacacaaaaccaaatgacaacaaacaaaataatggcagatcagaaacaacaaaatcaaggcctgaaaccccaaagcaaaagggtgaaagccggcctgagactccaaaacaaaagagtgatgggcatcctgaaaccccaaaacagaagggtgatggaaggcctgaaactccaaagcaaaaaggtgagagccgccctgaaactccaaagcaaaaaaatgaagggcgacctgaaacaccaaaacacaggcatgacaataggagggattctggaaagccatctacagagaaaaaacctgaagtgtctaaacataaacaagatactaaatctgactcacctcggttaaaatcagaacgagctgaagccttaaagcagagacctgatgggcgatctgtttctgagtcactaagacgtgaccatgataataaacaaaaatcagatgacaggggtgaatcagagcgacatcgaggggatcagtctagggttcgaagaccagaaacattgagatcctctagtagaaatgaacatggcattaaatctgatagttcaaaaactgataaactagaacgaaaacacaggcatgaatcaggggactcaagggaaagaccatcttctggggaacaaaaatcaagacctgacagtcctcgtgttaaacaaggagattctaataaatcaagatctgataaacttggttttaaatcaccaactagtaaagatgacaaaaggacagagggtaacaagagtaaagtagacactaataaagcacaccctgacaataaggcagaatttccaagttatttgttggggggcaggtctggtgcgttgaaaaattttgtcattccgaaaatcaagagggataaagatggcaatgttactcaggagacaaagaaaatggaaatgaaaggagagccgaaagacaaagtagaaaaaataggattagttgaagatctaaataaaggagctaagcctgtagttgtgctacaaaaactgtctttggatgatgttcagaaacttattaaagatagagaggacaaatcaagaagttcccttaaacctatcaagaataaaccatcaaagtcaaataaaggtagtatagatcaatcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatcctctaggaaacgacataaaaaagatgatgataaagcttgggaatatgaagagcgtgacagaagaagctctggggatcataggagaagtggccactctcatgaaggaagaaggagttcaggtggtggtcgttatcgaaaccgaagtccgtcagattctgacatggaagattattctcctcctcccagccttagtgaggttgctaggaaaatgaagaaaaaagaaaaacagaagaaaaggaaagcatatgaaccaaaactaacacctgaagaaatgatggactcttcaacttttaagagattcacagcctcaatagagaatattttggataatttggaagatatggattttactgcgtttggtgatgatgatgaaattcctcaggaactgctcttaggaaaacatcagcttaatgaacttggcagtgaatctgctaaaataaaagcaatgggtataatggataagctttcaactgacaaaactgtgaaagtcttaaatatcttggagaagaatattcaggatgggtcaaagctttccactttgttaaatcataataacgatactgaagaagaagaaaggttatggagagaccttattatggagagagttacaaaatcagcggatgcttgtcttacaactatcaacattatgacatcccctaacatgccaaaagctgtgtacattgaggatgtaattgaaagagttatacagtacactaaatttcatttgcagaatacactttatcctcagtatgatcctgtttacagattagatcctcatggaggaggcttattaagttcaaaagcaaaacgggctaaatgttctacccataagcagagagtaatagtaatgctttataacaaagtttgtgacattgttagcagcttatcagaattgctagagatacaacttcttacagacacaacaattcttcaggtttcatctatgggaataacaccattttttgtggaaaatgtcagtgaactacagttgtgtgccattaagttagtcactgcagtattctcaagatatgaaaaacataggcagttaattttggaagaaatttttacttcacttgcaagattaccaaccagcaagaggagtttaaggaacttcaggttaaacagtagtgatatggatggagaacctatgtatattcagatggttacagcactggttttacaacttattcagtgtgtggtacacttaccatcatcagagaaggactctaatgcagaagaagattcaaataaaaaaattgaccaggatgttgtcattactaactcttatgaaacagctatgcgaacagcccaaaacttcctctccatcttccttaaaaaatgtggtagtaagcaaggtgaagaagattacagaccactgtttgaaaattttgttcaagaccttctttcaacagtcaataagcctgaatggccagctgctgaactactccttagtttgttagggagactgttggttcatcagttcagtaacaagtcaacagagatggctttaagagtggcatctcttgattaccttggaactgttgctgcacggctaagaaaagatgctgttacaagcaaaatggatcaaggatctatagaacgcattttaaaacaggtttcaggaggggaagatgaaatccaacaattacaaaaagcattgcttgattacttggatgaaaacactgagactgatccttcactagtgttttctcgtaaattctatatagcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagatgaactctgatactgtggactatgatgatgcttgcttgattgttcgatacttggcctccatgaggccgtttgcccagagctttgatatttatttgacacagatcctacgagttcttggtgaaaatgcaattgctgttcgaacaaaagccatgaagtgtttgtctgaggttgttgctgtagaccccagtattctagcaaggcttgatatgcaacgaggtgttcatggacgattgatggataattcgactagtgtccgagaagcagcagtagaattactaggtcgatttgtcctttgtcgacctcagcttgctgaacagtattatgatatgctgattgaaagaatattggatactggtatcagtgtcaggaaaagagtaataaagattctcagagacatttgtattgaacaaccaacatttccaaaaatcacagaaatgtgtgtaaaaatgattcgcagagtcaatgatgaagagggcattaagaaattagtaaatgaaacattccagaaactctggtttactccaactccacacaatgacaaagaagcaatgacaaggaaaattttaaacattaccgatgtggttgcagcatgcagagatactggatatgactggtttgagcaactgcttcaaaacttgttgaagtccgaagaggattcctcatataaacctgtgaagaaagcttgtactcaacttgttgataacctagttgagcacattcttaaatatgaggaatctctagctgactctgacaataaaggtgtgaattctggaagattggtagcttgcataaccactttgttcttattcagcaaaataagaccccagctcatggttaaacatgcaatgactatgcaaccataccttaccactaaatgtagtacgcaaaatgatttcatggttatctgcaatgttgcaaaaatcctagagctagttgtaccactgatggagcatccaagtgaaacttttcttgccactattgaggaagatctaatgaagctcatcatcaaatatggcatgactgtagtgcaacattgtgtgagctgtcttggagctgttgtaaataaagtgacacaaaattttaaatttgtgtgggcttgtttcaatagatactatggtgccatttcaaaattaaaaagtcaacaccaagaggacccaaataacacttcacttctaacaaacaaaccagcacttcttagatcccttttcaccgttggagcactatgtcggcattttgattttgatctggaagattttaaaggcaacagcaaggttaacataaaagataaagtacttgaactattgatgtattttacaaaacactcagatgaagaagtacaaacaaaagctatcattggtctaggatttgcctttattcagcatccaagtctaatgttcgagcaagaagtgaagaatctatataataatattttatctgataagaactcctcagtcaatttaaaaatacaagtgttaaaaaacctccagacctacctacaagaagaagatacacgtatgcagcaggcagatagagactggaagaaagttgcaaaacaggaagacttaaaagaaatgggtgatgtttcctcagggatgagtagttccatcatgcagctttatctcaaacaggtgcttgaggcattttttcacacccagtcaagtgtacgccactttgccctaaatgtcattgcattgactctaaatcaaggtcttattcatccagttcagtgtgtgccatatttaattgctatgggcacagacccagaacctgctatgcggaacaaggctgatcagcaacttgtggaaatagacaaaaaatatgctggattcattcatatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcaaaaacagacgtgactatgctcttgtatatagcagacaatctagcctgttttccataccagacacaggaagagccgttgtttataatgcatcatatagacattacactctcagtttctggtagtaacctactgcagtcattcaaggagtctatggtaaaggacaaaaggaaagagagaaaatcatcacctagtaaggaaaatgagtcaagcgacagtgaagaagaagtttccaggcctcggaagtcacggaaacgtgtagattcagattcagattcagattcagaagacgatataaattcagtgatgaaatgtttgccagaaaattcagctcctttaatcgaatttgcaaatgtgtcccagggtattttattacttctcatgttaaaacaacatttgaagaatctttgtggattttctgatagtaaaattcagaagtactctccatctgaatctgcaaaagtatatgataaagcgataaaccgaaaaacaggagttcattttcatccaaaacaaacactggacttcctgcggagtgacatggctaattccaaaatcacagaagaggtgaaaaggagtatagtaaaacagtatctagatttcaaacttctcatggaacatctggaccctgatgaagaagaagaagaaggggaggtttcagctagcacaaatgctcggaacaaagcaattacctcactgcttggaggaggcagccctaaaaataatacagcagcagagacagaagatgatgaaagtgatggggaggatagaggaggaggcacttcaggggtgaggcggaggaggagtcaacgtatttcgcagcgtattacgtaaaatgatttttatgtgcttatatatgtcagtctattaaatgtacaccaagtaatgtaatacttaaaagagaaaacattttgtagatagagattctctacttacccgtttatacatccttttgtagaaagtttaacataaaagacaataaaaaaacagaaatgagatttatccagcataaagggttaatttttctttgaattgtattaatgtgtgttatttttattgttgctaagttttatgtagctatatggttcatatgtatatataattttatatatcaataagagtaaagacacgggtacaaattaagagttatatggttttacaagtatatgttaaccccttggcgctggcggtcacggtgcgtctcattgccggcaatggaagtgtgccgggaaatcccaactcccggcgtcaagggattaaaagcaataaaaacaataatttcactaaaattcttttgtgtaacacttggtcttttttcccccctcccaatgttttagtcattgagaaggtcaaaacgaaattcagactctacggagttggcagcacagatgaatgaaagtgttgacgtcatggatgtcatcgctatttgctgtccaaagtacaaagatcgaccacaaattgcaagagtagtgcagaaaaccagcagtggcttcagtgttcagtggatggcaggctcctacagtggctcctggactgaggctaagcgccgtgatggccgcaaactggtgccttgggtagacactattaaagagtcagacattatttacaaaaaaattgctctaacgagtgctaataagctgactaataaagttgttcagactttacgatccctgtatgccgccaaggatgggacttccagctaatgaatttgtacatgcagccaaatttacaggaatttttttaaaaggcagaaaaacttgaaataccaacattctggcaaaaaaaaatcagttttatgaagagtaagtggaacctgggatgcaggaacaaaagaaggaaatgttgggcaaacatttttgtgggagctcccttcgctgttgtgcagcagaaacagattctcagttcatttttactcccactgtattatagtttaacaaaaattgtttatatcttggaaaaaaaactttctgtttaaaaaaaataaacaagtgaatgttggaaattagtctgttaatgttcttaataaagtgttcttggagtttaacctagcagcggatggctttctttagcttagcccagtttccagggaagcattgttttttccaggctgtaaaatggcagaatctcctggatatataatttattctgttgaaaaaaaaaaaagcatgcagtatctatgacctatctgcagaaggagtttttgtaaatgtagattttgatgtattaggtcaccctgaaaacaatacaagaaaagggatccccaggtaatctggtggagcgaatactgcaataaatttttttacttctctttgtta

SEQ ID NO: 455134 - DNA, 8349 bp, Homo sapiens
cattagggaaaacataaagtggctgaatttacaaattattggtatccccaagcacaaagaaaggattagaaaacctatttaacaaagtaatgatgaaaactctcaagatctagcaagacatagagacattcagatataggagacacaatgatccctaggaagatacagtgcaaaaaaggtcttctcaacaaggcattataatcagactctctaaagtcaaagataagagtgaatcctaaaaatagcaagaaaaaagcatgtagctacctataaaggaaaccccatcaaactaacagtagatttttcagcagaaaccttacagctcgtgccgaattcggcacgaggtttgtcgcagcaagaacaaacagcattccttccagcaaatcaagtgcctgttttacaacagaacacttcagttgctgcaaaacaaccccagacttctgtggtacagaatcaacaacagatatcacaacagggacctatatatgatgaagtggaattggatgcattggctgaaattgagcgaatagagagagaatcagctattgaaagggagcgcttctcaaaagaagttcaagataaagataagcctttgaaaaaaagaaaacaagattcttacccacaggaggctgggggtgctacaggaggtaatagaccagcttctcaggagacgggttctacgggaaatgggtcaaggccagcattaatggttagcattgatcttcatcaggcaggaagagtggactctcaggcttctataactcaggattcagactccataaaaaagcctgaagaaatcaaacaatgtaatgatgcacctgtttctgttcttcaggaagatattgttggaagtcttaaatctacaccagaaaaccatcctgagacacctaaaaaaaagtctgatcctgagctttcaaagagtgaaatgaaacaaagtgaaagtagattagcagaatctaaaccaaatgaaaaccgattggtggagacaaaatcaagtgaaaataagttagaaactaaagttgagacccaaacagaagaacttaaacagaatgagagcagaacaactgaatgcaaacaaaacgagagcaccatagttgagcctaaacaaaatgaaaatagactgtctgacacaaaaccaaatgacaacaaacaaaataatggcagatcagaaacaacaaaatcaaggcctgaaaccccaaagcaaaagggtgaaagccggcctgagactccaaaacaaaagagtgatgggcatcctgaaaccccaaaacagaagggtgatggaaggcctgaaactccaaagcaaaaaggtgagagccgccctgaaactccaaagcaaaaaaatgaagggcgacctgaaacaccaaaacacaggcatgacaataggagggattctggaaagccatctacagagaaaaaacctgaagtgtctaaacataaacaagatactaaatctgactcacctcggttaaaatcagaacgagctgaagccttaaagcagagacctgatgggcgatctgtttctgagtcactaagacgtgaccatgataataaacaaaaatcagatgacaggggtgaatcagagcgacatcgaggggatcagtctagggttcgaagaccagaaacattgagatcctctagtagaaatgaacatggcattaaatctgatagttcaaaaactgataaactagaacgaaaacacaggcatgaatcaggggactcaagggaaagaccatcttctggggaacaaaaatcaagacctgacagtcctcgtgttaaacaaggagattctaataaatcaagatctgataaacttggttttaaatcaccaactagtaaagatgacaaaaggacagagggtaacaagagtaaagtagacactaataaagcacaccctgacaataaggcagaatttccaagttatttgttggggggcaggtctggtgcgttgaaaaattttgtcattccgaaaatcaagagggataaagatggcaatgttactcaggagacaaagaaaatggaaatgaaaggagagccgaaagacaaagtagaaaaaataggattagttgaagatctaaataaaggagctaagcctgtagttgtgctacaaaaactgtctttggatgatgttcagaaacttattaaagatagagaggacaaatcaagaagttcccttaaacctatcaagaataaaccatcaaagtcaaataaaggtagtatagatcaatcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatcctctaggaaacgacataaaaaagatgatgataaagcttgggaatatgaagagcgtgacagaagaagctctggggatcataggagaagtggccactctcatgaaggaagaaggagttcaggtggtggtcgttatcgaaaccgaagtccgtcagattctgacatggaagattattctcctcctcccagccttagtgaggttgctaggaaaatgaagaaaaaagaaaaacagaagaaaaggaaagcatatgaaccaaaactaacacctgaagaaatgatggactcttcaacttttaagagattcacagcctcaatagagaatattttggataatttggaagatatggattttactgcgtttggtgatgatgatgaaattcctcaggaactgctcttaggaaaacatcagcttaatgaacttggcagtgaatctgctaaaataaaagcaatgggtataatggataagctttcaactgacaaaactgtgaaagtcttaaatatcttggagaagaatattcaggatgggtcaaagctttccactttgttaaatcataataacgatactgaagaagaagaaaggttatggagagaccttattatggagagagttacaaaatcagcggatgcttgtcttacaactatcaacattatgacatcccctaacatgccaaaagctgtgtacattgaggatgtaattgaaagagttatacagtacactaaatttcatttgcagaatacactttatcctcagtatgatcctgtttacagattagatcctcatggaggaggcttattaagttcaaaagcaaaacgggctaaatgttctacccataagcagagagtaatagtaatgctttataacaaagtttgtgacattgttagcagcttatcagaattgctagagatacaacttcttacagacacaacaattcttcaggtttcatctatgggaataacaccattttttgtggaaaatgtcagtgaactacagttgtgtgccattaagttagtcactgcagtattctcaagatatgaaaaacataggcagttaattttggaagaaatttttacttcacttgcaagattaccaaccagcaagaggagtttaaggaacttcaggttaaacagtagtgatatggatggagaacctatgtatattcagatggttacagcactggttttacaacttattcagtgtgtggtacacttaccatcatcagagaaggactctaatgcagaagaagattcaaataaaaaaattgaccaggatgttgtcattactaactcttatgaaacagctatgcgaacagcccaaaacttcctctccatcttccttaaaaaatgtggtagtaagcaaggtgaagaagattacagaccactgtttgaaaattttgttcaagaccttctttcaacagtcaataagcctgaatggccagctgctgaactactccttagtttgttagggagactgttggttcatcagttcagtaacaagtcaacagagatggctttaagagtggcatctcttgattaccttggaactgttgctgcacggctaagaaaagatgctgttacaagcaaaatggatcaaggatctatagaacgcattttaaaacaggtttcaggaggggaagatgaaatccaacaattacaaaaagcattgcttgattacttggatgaaaacactgagactgatccttcactagtgttttctcgtaaattctatatagcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagatgaactctgatactgtggactatgatgatgcttgcttgattgttcgatacttggcctccatgaggccgtttgcccagagctttgatatttatttgacacagatcctacgagttcttggtgaaaatgcaattgctgttcgaacaaaagccatgaagtgtttgtctgaggttgttgctgtagaccccagtattctagcaaggcttgatatgcaacgaggtgttcatggacgattgatggataattcgactagtgtccgagaagcagcagtagaattactaggtcgatttgtcctttgtcgacctcagcttgctgaacagtattatgatatgctgattgaaagaatattggatactggtatcagtgtcaggaaaagagtaataaagattctcagagacatttgtattgaacaaccaacatttccaaaaatcacagaaatgtgtgtaaaaatgattcgcagagtcaatgatgaagagggcattaagaaattagtaaatgaaacattccagaaactctggtttactccaactccacacaatgacaaagaagcaatgacaaggaaaattttaaacattaccgatgtggttgcagcatgcagagatactggatatgactggtttgagcaactgcttcaaaacttgttgaagtccgaagaggattcctcatataaacctgtgaagaaagcttgtactcaacttgttgataacctagttgagcacattcttaaatatgaggaatctctagctgactctgacaataaaggtgtgaattctggaagattggtagcttgcataaccactttgttcttattcagcaaaataagaccccagctcatggttaaacatgcaatgactatgcaaccataccttaccactaaatgtagtacgcaaaatgatttcatggttatctgcaatgttgcaaaaatcctagagctagttgtaccactgatggagcatccaagtgaaacttttcttgccactattgaggaagatctaatgaagctcatcatcaaatatggcatgactgtagtgcaacattgtgtgagctgtcttggagctgttgtaaataaagtgacacaaaattttaaatttgtgtgggcttgtttcaatagatactatggtgccatttcaaaattaaaaagtcaacaccaagaggacccaaataacacttcacttctaacaaacaaaccagcacttcttagatcccttttcaccgttggagcactatgtcggcattttgattttgatctggaagattttaaaggcaacagcaaggttaacataaaagataaagtacttgaactattgatgtattttacaaaacactcagatgaagaagtacaaacaaaagctatcattggtctaggatttgcctttattcagcatccaagtctaatgttcgagcaagaagtgaagaatctatataataatattttatctgataagaactcctcagtcaatttaaaaatacaagtgttaaaaaacctccagacctacctacaagaagaagatacacgtatgcagcaggcagatagagactggaagaaagttgcaaaacaggaagacttaaaagaaatgggtgatgtttcctcagggatgagtagttccatcatgcagctttatctcaaacaggtgcttgaggcattttttcacacccagtcaagtgtacgccactttgccctaaatgtcattgcattgactctaaatcaaggtcttattcatccagttcagtgtgtgccatatttaattgctatgggcacagacccagaacctgctatgcggaacaaggctgatcagcaacttgtggaaatagacaaaaaatatgctggattcattcatatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcaaaaacagacgtgactatgctcttgtatatagcagacaatctagcctgttttccataccagacacaggaagagccgttgtttataatgcatcatatagacattacactctcagtttctggtagtaacctactgcagtcattcaaggagtctatggtaaaggacaaaaggaaagagagaaaatcatcacctagtaaggaaaatgagtcaagcgacagtgaagaagaagtttccaggcctcggaagtcacggaaacgtgtagattcagattcagattcagattcagaagacgatataaattcagtgatgaaatgtttgccagaaaattcagctcctttaatcgaatttgcaaatgtgtcccagggtattttattacttctcatgttaaaacaacatttgaagaatctttgtggattttctgatagtaaaattcagaagtactctccatctgaatctgcaaaagtatatgataaagcgataaaccgaaaaacaggagttcattttcatccaaaacaaacactggacttcctgcggagtgacatggctaattccaaaatcacagaagaggtgaaaaggagtatagtaaaacagtatctagatttcaaacttctcatggaacatctggaccctgatgaagaagaagaagaaggggaggtttcagctagcacaaatgctcggaacaaagcaattacctcactgcttggaggaggcagccctaaaaataatacagcagcagagacagaagatgatgaaagtgatggggaggatagaggaggaggcacttcaggggtgaggcggaggaggagtcaacgtatttcgcagcgtattacgtaaaatgatttttatgtgcttatatatgtcagtctattaaatgtacaccaagtaatgtaatacttaaaagagaaaacattttgtagatagagattctctacttacccgtttatacatccttttgtagaaagtttaacataaaagacaataaaaaaacagaaatgagatttatccagcataaagggttaatttttctttgaattgtattaatgtgtgttatttttattgttgctaagttttatgtagctatatggttcatatgtatatataattttatatatcaataagagtaaagacacgggtacaaattaagagttatatggttttacaagtatatgttaaccccttggcgctggcggtcacggtgcgtctcattgccggcaatggaagtgtgccgggaaatcccaactcccggcgtcaagggattaaaagcaataaaaacaataatttcactaaaattcttttgtgtaacacttggtcttttttcccccctcccaatgttttagtcattgagaaggtcaaaacgaaattcagactctacggagttggcagcacagatgaatgaaagtgttgacgtcatggatgtcatcgctatttgctgtccaaagtacaaagatcgaccacaaattgcaagagtagtgcagaaaaccagcagtggcttcagtgttcagtggatggcaggctcctacagtggctcctggactgaggctaagcgccgtgatggccgcaaactggtgccttgggtagacactattaaagagtcagacattatttacaaaaaaattgctctaacgagtgctaataagctgactaataaagttgttcagactttacgatccctgtatgccgccaaggatgggacttccagctaatgaatttgtacatgcagccaaatttacaggaatttttttaaaaggcagaaaaacttgaaataccaacattctggcaaaaaaaaatcagttttatgaagagtaagtggaacctgggatgcaggaacaaaagaaggaaatgttgggcaaacatttttgtgggagctcccttcgctgttgtgcagcagaaacagattctcagttcatttttactcccactgtattatagtttaacaaaaattgtttatatcttggaaaaaaaactttctgtttaaaaaaaataaacaagtgaatgttgga

SEQ ID NO: 455135 - DNA, 8968 bp, Homo sapiens
cagcatcggtatcaagtcccattgttgcaggtggtttgagaaacatacatgataataaagtttctggtccgttgtctggcaattcagctaatcatcatgctgataatcctagacatggttcaagtgaggactacctacacatggtgcacaggctaagtagtgacgatggagattcttcaacaatgaggaatgctgcatcttttcccttgagatctccacagccagtatgctcccctgctggaagtgaaggaactcctaaaggctcaagaccacctttaatcctacaatctcagtctctaccttgttcatcacctcgagatgttccaccagatatcttgctagattctccagaaagaaaacaaaagaagcagaagaaaatgaaattaggcaaggatgaaaaagagcagagtgagaaagcggcaatgtatgatataattagttctccatccaaggactctactaaacttacattaagactttctcgtgtaaggtcttcagacatggaccagcaagaggatatgatttctggtgtggaaaatagcaatgtttcagaaaatgatattccttttaatgtgcagtacccaggacagacttcaaaaacacccattactccacaagatataaaccgcccactaaatgctgctcaatgtttgtcgcagcaagaacaaacagcattccttccagcaaatcaagtgcctgttttacaacagaacacttcagttgctgcaaaacaaccccagacttctgtggtacagaatcaacaacagatatcacaacagggacctatatatgatgaagtggaattggatgcattggctgaaattgagcgaatagagagagaatcagctattgaaagggagcgcttctcaaaagaagttcaagataaagataagcctttgaaaaaaagaaaacaagattcttacccacaggaggctgggggtgctacaggaggtaatagaccagcttctcaggagacgggttctacgggaaatgggtcaaggccagcattaatggttagcattgatcttcatcaggcaggaagagtggactctcaggcttctataactcaggattcagactccataaaaaagcctgaagaaatcaaacaatgtaatgatgcacctgtttctgttcttcaggaagatattgttggaagtcttaaatctacaccagaaaaccatcctgagacacctaaaaaaaagtctgatcctgagctttcaaagagtgaaatgaaacaaagtgaaagtagattagcagaatctaaaccaaatgaaaaccgattggtggagacaaaatcaagtgaaaataagttagaaactaaagttgagacccaaacagaagaacttaaacagaatgagagcagaacaactgaatgcaaacaaaacgagagcaccatagttgagcctaaacaaaatgaaaatagactgtctgacacaaaaccaaatgacaacaaacaaaataatggcagatcagaaacaacaaaatcaaggcctgaaaccccaaagcaaaagggtgaaagccggcctgagactccaaaacaaaagagtgatgggcatcctgaaaccccaaaacagaagggtgatggaaggcctgaaactccaaagcaaaaaggtgagagccgccctgaaactccaaagcaaaaaaatgaagggcgacctgaaacaccaaaacacaggcatgacaataggagggattctggaaagccatctacagagaaaaaacctgaagtgtctaaacataaacaagatactaaatctgactcacctcggttaaaatcagaacgagctgaagccttaaagcagagacctgatgggcgatctgtttctgagtcactaagacgtgaccatgataataaacaaaaatcagatgacaggggtgaatcagagcgacatcgaggggatcagtctagggttcgaagaccagaaacattgagatcctctagtagaaatgaacatggcattaaatctgatagttcaaaaactgataaactagaacgaaaacacaggcatgaatcaggggactcaagggaaagaccatcttctggggaacaaaaatcaagacctgacagtcctcgtgttaaacaaggagattctaataaatcaagatctgataaacttggttttaaatcaccaactagtaaagatgacaaaaggacagagggtaacaagagtaaagtagacactaataaagcacaccctgacaataaggcagaatttccaagttatttgttggggggcaggtctggtgcgttgaaaaattttgtcattccgaaaatcaagagggataaagatggcaatgttactcaggagacaaagaaaatggaaatgaaaggagagccgaaagacaaagtagaaaaaataggattagttgaagatctaaataaaggagctaagcctgtagttgtgctacaaaaactgtctttggatgatgttcagaaacttattaaagatagagaggacaaatcaagaagttcccttaaacctatcaagaataaaccatcaaagtcaaataaaggtagtatagatcaatcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatcctctaggaaacgacataaaaaagatgatgataaagcttgggaatatgaagagcgtgacagaagaagctctggggatcataggagaagtggccactctcatgaaggaagaaggagttcaggtggtggtcgttatcgaaaccgaagtccgtcagattctgacatggaagattattctcctcctcccagccttagtgaggttgctaggaaaatgaagaaaaaagaaaaacagaagaaaaggaaagcatatgaaccaaaactaacacctgaagaaatgatggactcttcaacttttaagagattcacagcctcaatagagaatattttggataatttggaagatatggattttactgcgtttggtgatgatgatgaaattcctcaggaactgctcttaggaaaacatcagcttaatgaacttggcagtgaatctgctaaaataaaagcaatgggtataatggataagctttcaactgacaaaactgtgaaagtcttaaatatcttggagaagaatattcaggatgggtcaaagctttccactttgttaaatcataataacgatactgaagaagaagaaaggttatggagagaccttattatggagagagttacaaaatcagcggatgcttgtcttacaactatcaacattatgacatcccctaacatgccaaaagctgtgtacattgaggatgtaattgaaagagttatacagtacactaaatttcatttgcagaatacactttatcctcagtatgatcctgtttacagattagatcctcatggaggaggcttattaagttcaaaagcaaaacgggctaaatgttctacccataagcagagagtaatagtaatgctttataacaaagtttgtgacattgttagcagcttatcagaattgctagagatacaacttcttacagacacaacaattcttcaggtttcatctatgggaataacaccattttttgtggaaaatgtcagtgaactacagttgtgtgccattaagttagtcactgcagtattctcaagatatgaaaaacataggcagttaattttggaagaaatttttacttcacttgcaagattaccaaccagcaagaggagtttaaggaacttcaggttaaacagtagtgatatggatggagaacctatgtatattcagatggttacagcactggttttacaacttattcagtgtgtggtacacttaccatcatcagagaaggactctaatgcagaagaagattcaaataaaaaaattgaccaggatgttgtcattactaactcttatgaaacagctatgcgaacagcccaaaacttcctctccatcttccttaaaaaatgtggtagtaagcaaggtgaagaagattacagaccactgtttgaaaattttgttcaagaccttctttcaacagtcaataagcctgaatggccagctgctgaactactccttagtttgttagggagactgttggttcatcagttcagtaacaagtcaacagagatggctttaagagtggcatctcttgattaccttggaactgttgctgcacggctaagaaaagatgctgttacaagcaaaatggatcaaggatctatagaacgcattttaaaacaggtttcaggaggggaagatgaaatccaacaattacaaaaagcattgcttgattacttggatgaaaacactgagactgatccttcactagtgttttctcgtaaattctatatagcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagatgaactctgatactgtggactatgatgatgcttgcttgattgttcgatacttggcctccatgaggccgtttgcccagagctttgatatttatttgacacagatcctacgagttcttggtgaaaatgcaattgctgttcgaacaaaagccatgaagtgtttgtctgaggttgttgctgtagaccccagtattctagcaaggcttgatatgcaacgaggtgttcatggacgattgatggataattcgactagtgtccgagaagcagcagtagaattactaggtcgatttgtcctttgtcgacctcagcttgctgaacagtattatgatatgctgattgaaagaatattggatactggtatcagtgtcaggaaaagagtaataaagattctcagagacatttgtattgaacaaccaacatttccaaaaatcacagaaatgtgtgtaaaaatgattcgcagagtcaatgatgaagagggcattaagaaattagtaaatgaaacattccagaaactctggtttactccaactccacacaatgacaaagaagcaatgacaaggaaaattttaaacattaccgatgtggttgcagcatgcagagatactggatatgactggtttgagcaactgcttcaaaacttgttgaagtccgaagaggattcctcatataaacctgtgaagaaagcttgtactcaacttgttgataacctagttgagcacattcttaaatatgaggaatctctagctgactctgacaataaaggtgtgaattctggaagattggtagcttgcataaccactttgttcttattcagcaaaataagaccccagctcatggttaaacatgcaatgactatgcaaccataccttaccactaaatgtagtacgcaaaatgatttcatggttatctgcaatgttgcaaaaatcctagagctagttgtaccactgatggagcatccaagtgaaacttttcttgccactattgaggaagatctaatgaagctcatcatcaaatatggcatgactgtagtgcaacattgtgtgagctgtcttggagctgttgtaaataaagtgacacaaaattttaaatttgtgtgggcttgtttcaatagatactatggtgccatttcaaaattaaaaagtcaacaccaagaggacccaaataacacttcacttctaacaaacaaaccagcacttcttagatcccttttcaccgttggagcactatgtcggcattttgattttgatctggaagattttaaaggcaacagcaaggttaacataaaagataaagtacttgaactattgatgtattttacaaaacactcagatgaagaagtacaaacaaaagctatcattggtctaggatttgcctttattcagcatccaagtctaatgttcgagcaagaagtgaagaatctatataataatattttatctgataagaactcctcagtcaatttaaaaatacaagtgttaaaaaacctccagacctacctacaagaagaagatacacgtatgcagcaggcagatagagactggaagaaagttgcaaaacaggaagacttaaaagaaatgggtgatgtttcctcagggatgagtagttccatcatgcagctttatctcaaacaggtgcttgaggcattttttcacacccagtcaagtgtacgccactttgccctaaatgtcattgcattgactctaaatcaaggtcttattcatccagttcagtgtgtgccatatttaattgctatgggcacagacccagaacctgctatgcggaacaaggctgatcagcaacttgtggaaatagacaaaaaatatgctggattcattcatatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcaaaaacagacgtgactatgctcttgtatatagcagacaatctagcctgttttccataccagacacaggaagagccgttgtttataatgcatcatatagacattacactctcagtttctggtagtaacctactgcagtcattcaaggagtctatggtaaaggacaaaaggaaagagagaaaatcatcacctagtaaggaaaatgagtcaagcgacagtgaagaagaagtttccaggcctcggaagtcacggaaacgtgtagattcagattcagattcagattcagaagacgatataaattcagtgatgaaatgtttgccagaaaattcagctcctttaatcgaatttgcaaatgtgtcccagggtattttattacttctcatgttaaaacaacatttgaagaatctttgtggattttctgatagtaaaattcagaagtactctccatctgaatctgcaaaagtatatgataaagcgataaaccgaaaaacaggagttcattttcatccaaaacaaacactggacttcctgcggagtgacatggctaattccaaaatcacagaagaggtgaaaaggagtatagtaaaacagtatctagatttcaaacttctcatggaacatctggaccctgatgaagaagaagaagaaggggaggtttcagctagcacaaatgctcggaacaaagcaattacctcactgcttggaggaggcagccctaaaaataatacagcagcagagacagaagatgatgaaagtgatggggaggatagaggaggaggcacttcaggggtgaggcggaggaggagtcaacgtatttcgcagcgtattacgtaaaatgatttttatgtgcttatatatgtcagtctattaaatgtacaccaagtaatgtaatacttaaaagagaaaacattttgtagatagagattctctacttacccgtttatacatccttttgtagaaagtttaacataaaagacaataaaaaaacagaaatgagatttatccagcataaagggttaatttttctttgaattgtattaatgtgtgttatttttattgttgctaagttttatgtagctatatggttcatatgtatatataattttatatatcaataagagtaaagacacgggtacaaattaagagttatatggttttacaagtatatgttaaccccttggcgctggcggtcacggtgcgtctcattgccggcaatggaagtgtgccgggaaatcccaactcccggcgtcaagggattaaaagcaataaaaacaataatttcactaaaattcttttgtgtaacacttggtcttttttcccccctcccaatgttttagtcattgagaaggtcaaaacgaaattcagactctacggagttggcagcacagatgaatgaaagtgttgacgtcatggatgtcatcgctatttgctgtccaaagtacaaagatcgaccacaaattgcaagagtagtgcagaaaaccagcagtggcttcagtgttcagtggatggcaggctcctacagtggctcctggactgaggctaagcgccgtgatggccgcaaactggtgccttgggtagacactattaaagagtcagacattatttacaaaaaaattgctctaacgagtgctaataagctgactaataaagttgttcagactttacgatccctgtatgccgccaaggatgggacttccagctaatgaatttgtacatgcagccaaatttacaggaatttttttaaaaggcagaaaaacttgaaataccaacattctggcaaaaaaaaatcagttttatgaagagtaagtggaacctgggatgcaggaacaaaagaaggaaatgttgggcaaacatttttgtgggagctcccttcgctgttgtgcagcagaaacagattctcagttcatttttactcccactgtattatagtttaacaaaaattgtttatatcttggaaaaaaaactttctgtttaaaaaaaataaacaagtgaatgttggaaattagtctgttaatgttcttaataaagtgttcttggagtttaacctagcagcggatggctttctttagcttagcccagtttccagggaagcattgttttttccaggctgtaaaatggcagaatctcctggatatataatttattctgttgaaaaaaaaaaaagcatgcagtatctatgacctatctgcagaaggagtttttgtaaatgtagattttgatgtattaggtcaccctgaaaacaatacaagaaaagggatccccaggtaatctggtggagcgaatactgcaataaatttttttacttctctttgtta

SEQ ID NO: 455136 - DNA, 5182 bp, Homo sapiens
tacaaaatttataaactattatttgagaacattatacatagagatattttattttattttttaactggtgggatatgcaattgaaagaaatgggatactactaagctcttcagccaaatactgtaggttttcagtttgtattcaaaggaacagatttacaggtgtgtctcagtgttaaactatttcagtgacaattgtcttgtgtgtttcttggagaactaaggcaaaatttgaaaacagatgaagtcttctaccttcagcattttatcaatttgttttaaactttcctagttgacccatcatctgtttaactttgtcatgatgttgtccttgattaagtagttgataatagtattctatatttaatacagttgtgtttatcaaattatcttgacttcattaatataagtattggaacatagtaaaataataagttttctaacatttaggatattctatattttctggctttcttaaaatctgtttttatcacatggaagttgttttaaagtaaactttaatatttgtattcctgtaatgtgagcactctaactttattaacttggaaatcttgttgctaatttcatcaagctcaagtctgtctaatttctttccagttttctcgtaaattctatatagcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagatgaactctgatactgtggactatgatgatgcttgcttgattgttcgatacttggcctccatgaggccgtttgcccagagctttgatatttatttgacacagatcctacgagttcttggtgaaaatgcaattgctgttcgaacaaaagccatgaagtgtttgtctgaggttgttgctgtagaccccagtattctagcaaggcttgatatgcaacgaggtgttcatggacgattgatggataattcgactagtgtccgagaagcagcagtagaattactaggtcgatttgtcctttgtcgacctcagcttgctgaacagtattatgatatgctgattgaaagaatattggatactggtatcagtgtcaggaaaagagtaataaagattctcagagacatttgtattgaacaaccaacatttccaaaaatcacagaaatgtgtgtaaaaatgattcgcagagtcaatgatgaagagggcattaagaaattagtaaatgaaacattccagaaactctggtttactccaactccacacaatgacaaagaagcaatgacaaggaaaattttaaacattaccgatgtggttgcagcatgcagagatactggatatgactggtttgagcaactgcttcaaaacttgttgaagtccgaagaggattcctcatataaacctgtgaagaaagcttgtactcaacttgttgataacctagttgagcacattcttaaatatgaggaatctctagctgactctgacaataaaggtgtgaattctggaagattggtagcttgcataaccactttgttcttattcagcaaaataagaccccagctcatggttaaacatgcaatgactatgcaaccataccttaccactaaatgtagtacgcaaaatgatttcatggttatctgcaatgttgcaaaaatcctagagctagttgtaccactgatggagcatccaagtgaaacttttcttgccactattgaggaagatctaatgaagctcatcatcaaatatggcatgactgtagtgcaacattgtgtgagctgtcttggagctgttgtaaataaagtgacacaaaattttaaatttgtgtgggcttgtttcaatagatactatggtgccatttcaaaattaaaaagtcaacaccaagaggacccaaataacacttcacttctaacaaacaaaccagcacttcttagatcccttttcaccgttggagcactatgtcggcattttgattttgatctggaagattttaaaggcaacagcaaggttaacataaaagataaagtacttgaactattgatgtattttacaaaacactcagatgaagaagtacaaacaaaagctatcattggtctaggatttgcctttattcagcatccaagtctaatgttcgagcaagaagtgaagaatctatataataatattttatctgataagaactcctcagtcaatttaaaaatacaagtgttaaaaaacctccagacctacctacaagaagaagatacacgtatgcagcaggcagatagagactggaagaaagttgcaaaacaggaagacttaaaagaaatgggtgatgtttcctcagggatgagtagttccatcatgcagctttatctcaaacaggtgcttgaggcattttttcacacccagtcaagtgtacgccactttgccctaaatgtcattgcattgactctaaatcaaggtcttattcatccagttcagtgtgtgccatatttaattgctatgggcacagacccagaacctgctatgcggaacaaggctgatcagcaacttgtggaaatagacaaaaaatatgctggattcattcatatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcaaaaacagacgtgactatgctcttgtatatagcagacaatctagcctgttttccataccagacacaggaagagccgttgtttataatgcatcatatagacattacactctcagtttctggtagtaacctactgcagtcattcaaggagtctatggtaaaggacaaaaggaaagagagaaaatcatcacctagtaaggaaaatgagtcaagcgacagtgaagaagaagtttccaggcctcggaagtcacggaaacgtgtagattcagattcagattcagattcagaagacgatataaattcagtgatgaaatgtttgccagaaaattcagctcctttaatcgaatttgcaaatgtgtcccagggtattttattacttctcatgttaaaacaacatttgaagaatctttgtggattttctgatagtaaaattcagaagtactctccatctgaatctgcaaaagtatatgataaagcgataaaccgaaaaacaggagttcattttcatccaaaacaaacactggacttcctgcggagtgacatggctaattccaaaatcacagaagaggtgaaaaggagtatagtaaaacagtatctagatttcaaacttctcatggaacatctggaccctgatgaagaagaagaagaaggggaggtttcagctagcacaaatgctcggaacaaagcaattacctcactgcttggaggaggcagccctaaaaataatacagcagcagagacagaagatgatgaaagtgatggggaggatagaggaggaggcacttcaggggtgaggcggaggaggagtcaacgtatttcgcagcgtattacgtaaaatgatttttatgtgcttatatatgtcagtctattaaatgtacaccaagtaatgtaatacttaaaagagaaaacattttgtagatagagattctctacttacccgtttatacatccttttgtagaaagtttaacataaaagacaataaaaaaacagaaatgagatttatccagcataaagggttaatttttctttgaattgtattaatgtgtgttatttttattgttgctaagttttatgtagctatatggttcatatgtatatataattttatatatcaataagagtaaagacacgggtacaaattaagagttatatggttttacaagtatatgttaaccccttggcgctggcggtcacggtgcgtctcattgccggcaatggaagtgtgccgggaaatcccaactcccggcgtcaagggattaaaagcaataaaaacaataatttcactaaaattcttttgtgtaacacttggtcttttttcccccctcccaatgttttagtcattgagaaggtcaaaacgaaattcagactctacggagttggcagcacagatgaatgaaagtgttgacgtcatggatgtcatcgctatttgctgtccaaagtacaaagatcgaccacaaattgcaagagtagtgcagaaaaccagcagtggcttcagtgttcagtggatggcaggctcctacagtggctcctggactgaggctaagcgccgtgatggccgcaaactggtgccttgggtagacactattaaagagtcagacattatttacaaaaaaattgctctaacgagtgctaataagctgactaataaagttgttcagactttacgatccctgtatgccgccaaggatgggacttccagctaatgaatttgtacatgcagccaaatttacaggaatttttttaaaaggcagaaaaacttgaaataccaacattctggcaaaaaaaaatcagttttatgaagagtaagtggaacctgggatgcaggaacaaaagaaggaaatgttgggcaaacatttttgtgggagctcccttcgctgttgtgcagcagaaacagattctcagttcatttttactcccactgtattatagtttaacaaaaattgtttatatcttggaaaaaaaactttctgtttaaaaaaaataaacaagtgaatgttggaaattagtctgttaatgttcttaataaagtgttcttggagtttaacctagcagcggatggctttctttagcttagcccagtttccagggaagcattgttttttccaggctgtaaaatggcagaatctcctggatatataatttattctgttgaaaaaaaaaaaagcatgcagtatctatgacctatctgcagaaggagtttttgtaaatgtagattttgatgtattaggtcaccctgaaaacaatacaagaaaagggatccccaggtaatctggtggagcgaatactgcaataaatttttttacttctctttgtta

SEQ ID NO: 455137 - DNA, 8420 bp, Homo sapiens
cagcatcggtatcaagtcccattgttgcaggtggtttgagaaacatacatgataataaagtttctggtccgttgtctggcaattcagctaatcatcatgctgataatcctagacatggttcaagtgaggactacctacacatggtgcacaggctaagtagtgacgatggagattcttcaacaatgaggaatgctgcatcttttcccttgagatctccacagccagtatgctcccctgctggaagtgaaggaactcctaaaggctcaagaccacctttaatcctacaatctcagtctctaccttgttcatcacctcgagatgttccaccagatatcttgctagattctccagaaagaaaacaaaagaagcagaagaaaatgaaattaggcaaggatgaaaaagagcagagtgagaaagcggcaatgtatgatataattagttctccatccaaggactctactaaacttacattaagactttctcgtgtaaggtcttcagacatggaccagcaagaggatatgatttctggtgtggaaaatagcaatgtttcagaaaatgatattccttttaatgtgcagtacccaggacagacttcaaaaacacccattactccacaagatataaaccgcccactaaatgctgctcaatgtttgtcgcagcaagaacaaacagcattccttccagcaaatcaagtgcctgttttacaacagaacacttcagttgctgcaaaacaaccccagacttctgtggtacagaatcaacaacagatatcacaacagggacctatatatgatgaagtggaattggatgcattggctgaaattgagcgaatagagagagaatcagctattgaaagggagcgcttctcaaaagaagttcaagataaagataagcctttgaaaaaaagaaaacaagattcttacccacaggaggctgggggtgctacaggaggtaatagaccagcttctcaggagacgggttctacgggaaatgggtcaaggccagcattaatggttagcattgatcttcatcaggcaggaagagtggactctcaggcttctataactcaggattcagactccataaaaaagcctgaagaaatcaaacaatgtaatgatgcacctgtttctgttcttcaggaagatattgttggaagtcttaaatctacaccagaaaaccatcctgagacacctaaaaaaaagtctgatcctgagctttcaaagagtgaaatgaaacaaagtgaaagtagattagcagaatctaaaccaaatgaaaaccgattggtggagacaaaatcaagtgaaaataagttagaaactaaagttgagacccaaacagaagaacttaaacagaatgagagcagaacaactgaatgcaaacaaaacgagagcaccatagttgagcctaaacaaaatgaaaatagactgtctgacacaaaaccaaatgacaacaaacaaaataatggcagatcagaaacaacaaaatcaaggcctgaaaccccaaagcaaaagggtgaaagccggcctgagactccaaaacaaaagagtgatgggcatcctgaaaccccaaaacagaagggtgatggaaggcctgaaactccaaagcaaaaaggtgagagccgccctgaaactccaaagcaaaaaaatgaagggcgacctgaaacaccaaaacacaggcatgacaataggagggattctggaaagccatctacagagaaaaaacctgaagtgtctaaacataaacaagatactaaatctgactcacctcggttaaaatcagaacgagctgaagccttaaagcagagacctgatgggcgatctgtttctgagtcactaagacgtgaccatgataataaacaaaaatcagatgacaggggtgaatcagagcgacatcgaggggatcagtctagggttcgaagaccagaaacattgagatcctctagtagaaatgaacatggcattaaatctgatagttcaaaaactgataaactagaacgaaaacacaggcatgaatcaggggactcaagggaaagaccatcttctggggaacaaaaatcaagacctgacagtcctcgtgttaaacaaggagattctaataaatcaagatctgataaacttggttttaaatcaccaactagtaaagatgacaaaaggacagagggtaacaagagtaaagtagacactaataaagcacaccctgacaataaggcagaatttccaagttatttgttggggggcaggtctggtgcgttgaaaaattttgtcattccgaaaatcaagagggataaagatggcaatgttactcaggagacaaagaaaatggaaatgaaaggagagccgaaagacaaagtagaaaaaataggattagttgaagatctaaataaaggagctaagcctgtagttgtgctacaaaaactgtctttggatgatgttcagaaacttattaaagatagagaggacaaatcaagaagttcccttaaacctatcaagaataaaccatcaaagtcaaataaaggtagtatagatcaatcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatcctctaggaaacgacataaaaaagatgatgataaagcttgggaatatgaagagcgtgacagaagaagctctggggatcataggagaagtggccactctcatgaaggaagaaggagttcaggtggtggtcgttatcgaaaccgaagtccgtcagattctgacatggaagattattctcctcctcccagccttagtgaggttgctaggaaaatgaagaaaaaagaaaaacagaagaaaaggaaagcatatgaaccaaaactaacacctgaagaaatgatggactcttcaacttttaagagattcacagcctcaatagagaatattttggataatttggaagatatggattttactgcgtttggtgatgatgatgaaattcctcaggaactgctcttaggaaaacatcagcttaatgaacttggcagtgaatctgctaaaataaaagcaatgggtataatggataagctttcaactgacaaaactgtgaaagtcttaaatatcttggagaagaatattcaggatgggtcaaagctttccactttgttaaatcataataacgatactgaagaagaagaaaggttatggagagaccttattatggagagagttacaaaatcagcggatgcttgtcttacaactatcaacattatgacatcccctaacatgccaaaagctgtgtacattgaggatgtaattgaaagagttatacagtacactaaatttcatttgcagaatacactttatcctcagtatgatcctgtttacagattagatcctcatggaggaggcttattaagttcaaaagcaaaacgggctaaatgttctacccataagcagagagtaatagtaatgctttataacaaagtttgtgacattgttagcagcttatcagaattgctagagatacaacttcttacagacacaacaattcttcaggtttcatctatgggaataacaccattttttgtggaaaatgtcagtgaactacagttgtgtgccattaagttagtcactgcagtattctcaagatatgaaaaacataggcagttaattttggaagaaatttttacttcacttgcaagattaccaaccagcaagaggagtttaaggaacttcaggttaaacagtagtgatatggatggagaacctatgtatattcagatggttacagcactggttttacaacttattcagtgtgtggtacacttaccatcatcagagaaggactctaatgcagaagaagattcaaataaaaaaattgaccaggatgttgtcattactaactcttatgaaacagctatgcgaacagcccaaaacttcctctccatcttccttaaaaaatgtggtagtaagcaaggtgaagaagattacagaccactgtttgaaaattttgttcaagaccttctttcaacagtcaataagcctgaatggccagctgctgaactactccttagtttgttagggagactgttggttcatcagttcagtaacaagtcaacagagatggctttaagagtggcatctcttgattaccttggaactgttgctgcacggctaagaaaagatgctgttacaagcaaaatggatcaaggatctatagaacgcattttaaaacaggtttcaggaggggaagatgaaatccaacaattacaaaaagcattgcttgattacttggatgaaaacactgagactgatccttcactagtgttttctcgtaaattctatatagcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagatgaactctgatactgtggactatgatgatgcttgcttgattgttcgatacttggcctccatgaggccgtttgcccagagctttgatatttatttgacacagatcctacgagttcttggtgaaaatgcaattgctgttcgaacaaaagccatgaagtgtttgtctgaggttgttgctgtagaccccagtattctagcaaggcttgatatgcaacgaggtgttcatggacgattgatggataattcgactagtgtccgagaagcagcagtagaattactaggtcgatttgtcctttgtcgacctcagcttgctgaacagtattatgatatgctgattgaaagaatattggatactggtatcagtgtcaggaaaagagtaataaagattctcagagacatttgtattgaacaaccaacatttccaaaaatcacagaaatgtgtgtaaaaatgattcgcagagtcaatgatgaagagggcattaagaaattagtaaatgaaacattccagaaactctggtttactccaactccacacaatgacaaagaagcaatgacaaggaaaattttaaacattaccgatgtggttgcagcatgcagagatactggatatgactggtttgagcaactgcttcaaaacttgttgaagtccgaagaggattcctcatataaacctgtgaagaaagcttgtactcaacttgttgataacctagttgagcacattcttaaatatgaggaatctctagctgactctgacaataaaggtgtgaattctggaagattggtagcttgcataaccactttgttcttattcagcaaaataagaccccagctcatggttaaacatgcaatgactatgcaaccataccttaccactaaatgtagtacgcaaaatgatttcatggttatctgcaatgttgcaaaaatcctagagctagttgtaccactgatggagcatccaagtgaaacttttcttgccactattgaggaagatctaatgaagctcatcatcaaatatggcatgactgtagtgcaacattgtgtgagctgtcttggagctgttgtaaataaagtgacacaaaattttaaatttgtgtgggcttgtttcaatagatactatggtgccatttcaaaattaaaaagtcaacaccaagaggacccaaataacacttcacttctaacaaacaaaccagcacttcttagatcccttttcaccgttggagcactatgtcggcattttgattttgatctggaagattttaaaggcaacagcaaggttaacataaaagataaagtacttgaactattgatgtattttacaaaacactcagatgaagaagtacaaacaaaagctatcattggtctaggatttgcctttattcagcatccaagtctaatgttcgagcaagaagtgaagaatctatataataatattttatctgataagaactcctcagtcaatttaaaaatacaagtgttaaaaaacctccagacctacctacaagaagaagatacacgtatgcagcaggcagatagagactggaagaaagttgcaaaacaggaagacttaaaagaaatgggtgatgtttcctcagggatgagtagttccatcatgcagctttatctcaaacaggtgcttgaggcattttttcacacccagtcaagtgtacgccactttgccctaaatgtcattgcattgactctaaatcaaggtcttattcatccagttcagtgtgtgccatatttaattgctatgggcacagacccagaacctgctatgcggaacaaggctgatcagcaacttgtggaaatagacaaaaaatatgctggattcattcatatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcaaaaacagacgtgactatgctcttgtatatagcagacaatctagcctgttttccataccagacacaggaagagccgttgtttataatgcatcatatagacattacactctcagtttctggtagtaacctactgcagtcattcaaggagtctatggtaaaggacaaaaggaaagagagaaaatcatcacctagtaaggaaaatgagtcaagcgacagtgaagaagaagtttccaggcctcggaagtcacggaaacgtgtagattcagattcagattcagattcagaagacgatataaattcagtgatgaaatgtttgccagaaaattcagctcctttaatcgaatttgcaaatgtgtcccagggtattttattacttctcatgttaaaacaacatttgaagaatctttgtggattttctgatagtaaaattcagaagtactctccatctgaatctgcaaaagtatatgataaagcgataaaccgaaaaacaggagttcattttcatccaaaacaaacactggacttcctgcggagtgacatggctaattccaaaatcacagaagaggtgaaaaggagtatagtaaaacagtatctagatttcaaacttctcatggaacatctggaccctgatgaagaagaagaagaaggggaggtttcagctagcacaaatgctcggaacaaagcaattacctcactgcttggaggaggcagccctaaaaataatacagcagcagagacagaagatgatgaaagtgatggggaggatagaggaggaggcacttcagggtcattgagaaggtcaaaacgaaattcagactctacggagttggcagcacagatgaatgaaagtgttgacgtcatggatgtcatcgctatttgctgtccaaagtacaaagatcgaccacaaattgcaagagtagtgcagaaaaccagcagtggcttcagtgttcagtggatggcaggctcctacagtggctcctggactgaggctaagcgccgtgatggccgcaaactggtgccttgggtagacactattaaagagtcagacattatttacaaaaaaattgctctaacgagtgctaataagctgactaataaagttgttcagactttacgatccctgtatgccgccaaggatgggacttccagctaatgaatttgtacatgcagccaaatttacaggaatttttttaaaaggcagaaaaacttgaaataccaacattctggcaaaaaaaaatcagttttatgaagagtaagtggaacctgggatgcaggaacaaaagaaggaaatgttgggcaaacatttttgtgggagctcccttcgctgttgtgcagcagaaacagattctcagttcatttttactcccactgtattatagtttaacaaaaattgtttatatcttggaaaaaaaactttctgtttaaaaaaaataaacaagtgaatgttggaaattagtctgttaatgttcttaataaagtgttcttggagtttaacctagcagcggatggctttctttagcttagcccagtttccagggaagcattgttttttccaggctgtaaaatggcagaatctcctggatatataatttattctgttgaaaaaaaaaaaagcatgcagtatctatgacctatctgcagaaggagtttttgtaaatgtagattttgatgtattaggtcaccctgaaaacaatacaagaaaagggatccccaggtaatctggtggagcgaatactgcaataaatttttttacttctctttgtta

SEQ ID NO: 455138 - DNA, 8793 bp, Homo sapiens
cagcatcggtatcaagtcccattgttgcaggtggtttgagaaacatacatgataataaagtttctggtccgttgtctggcaattcagctaatcatcatgctgataatcctagacatggttcaagtgaggactacctacacatggtgcacaggctaagtagtgacgatggagattcttcaacaatgaggaatgctgcatcttttcccttgagatctccacagccagtatgctcccctgctggaagtgaaggaactcctaaaggctcaagaccacctttaatcctacaatctcagtctctaccttgttcatcacctcgagatgttccaccagatatcttgctagattctccagaaagaaaacaaaagaagcagaagaaaatgaaattaggcaaggatgaaaaagagcagagtgagaaagcggcaatgtatgatataattagttctccatccaaggactctactaaacttacattaagactttctcgtgtaaggtcttcagacatggaccagcaagaggatatgatttctggtgtggaaaatagcaatgtttcagaaaatgatattccttttaatgtgcagtacccaggacagacttcaaaaacacccattactccacaagatataaaccgcccactaaatgctgctcaatgtttgtcgcagcaagaacaaacagcattccttccagcaaatcaagtgcctgttttacaacagaacacttcagttgctgcaaaacaaccccagacttctgtggtacagaatcaacaacagatatcacaacagggacctatatatgatgaagtggaattggatgcattggctgaaattgagcgaatagagagagaatcagctattgaaagggagcgcttctcaaaagaagttcaagataaagataagcctttgaaaaaaagaaaacaagattcttacccacaggaggctgggggtgctacaggaggtaatagaccagcttctcaggagacgggttctacgggaaatgggtcaaggccagcattaatggttagcattgatcttcatcaggcaggaagagtggactctcaggcttctataactcaggattcagactccataaaaaagcctgaagaaatcaaacaatgtaatgatgcacctgtttctgttcttcaggaagatattgttggaagtcttaaatctacaccagaaaaccatcctgagacacctaaaaaaaagtctgatcctgagctttcaaagagtgaaatgaaacaaagtgaaagtagattagcagaatctaaaccaaatgaaaaccgattggtggagacaaaatcaagtgaaaataagttagaaactaaagttgagacccaaacagaagaacttaaacagaatgagagcagaacaactgaatgcaaacaaaacgagagcaccatagttgagcctaaacaaaatgaaaatagactgtctgacacaaaaccaaatgacaacaaacaaaataatggcagatcagaaacaacaaaatcaaggcctgaaaccccaaagcaaaagggtgaaagccggcctgagactccaaaacaaaagagtgatgggcatcctgaaaccccaaaacagaagggtgatggaaggcctgaaactccaaagcaaaaaggtgagagccgccctgaaactccaaagcaaaaaaatgaagggcgacctgaaacaccaaaacacaggcatgacaataggagggattctggaaagccatctacagagaaaaaacctgaagtgtctaaacataaacaagatactaaatctgactcacctcggttaaaatcagaacgagctgaagccttaaagcagagacctgatgggcgatctgtttctgagtcactaagacgtgaccatgataataaacaaaaatcagatgacaggggtgaatcagagcgacatcgaggggatcagtctagggttcgaagaccagaaacattgagatcctctagtagaaatgaacatggcattaaatctgatagttcaaaaactgataaactagaacgaaaacacaggcatgaatcaggggactcaagggaaagaccatcttctggggaacaaaaatcaagacctgacagtcctcgtgttaaacaaggagattctaataaatcaagatctgataaacttggttttaaatcaccaactagtaaagatgacaaaaggacagagggtaacaagagtaaagtagacactaataaagcacaccctgacaataaggcagaatttccaagttatttgttggggggcaggtctggtgcgttgaaaaattttgtcattccgaaaatcaagagggataaagatggcaatgttactcaggagacaaagaaaatggaaatgaaaggagagccgaaagacaaagtagaaaaaataggattagttgaagatctaaataaaggagctaagcctgtagttgtgctacaaaaactgtctttggatgatgttcagaaacttattaaagatagagaggacaaatcaagaagttcccttaaacctatcaagaataaaccatcaaagtcaaataaaggtagtatagatcaatcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatcctctaggaaacgacataaaaaagatgatgataaagcttgggaatatgaagagcgtgacagaagaagctctggggatcataggagaagtggccactctcatgaaggaagaaggagttcaggtggtggtcgttatcgaaaccgaagtccgtcagattctgacatggaagattattctcctcctcccagccttagtgaggttgctaggaaaatgaagaaaaaagaaaaacagaagaaaaggaaagcatatgaaccaaaactaacacctgaagaaatgatggactcttcaacttttaagagattcacagcctcaatagagaatattttggataatttggaagatatggattttactgcgtttggtgatgatgatgaaattcctcaggaactgctcttaggaaaacatcagcttaatgaacttggcagtgaatctgctaaaataaaagcaatgggtataatggataagctttcaactgacaaaactgtgaaagtcttaaatatcttggagaagaatattcaggatgggtcaaagctttccactttgttaaatcataataacgatactgaagaagaagaaaggttatggagagaccttattatggagagagttacaaaatcagcggatgcttgtcttacaactatcaacattatgacatcccctaacatgccaaaagctgtgtacattgaggatgtaattgaaagagttatacagtacactaaatttcatttgcagaatacactttatcctcagtatgatcctgtttacagattagatcctcatggaggaggcttattaagttcaaaagcaaaacgggctaaatgttctacccataagcagagagtaatagtaatgctttataacaaagtttgtgacattgttagcagcttatcagaattgctagagatacaacttcttacagacacaacaattcttcaggtttcatctatgggaataacaccattttttgtggaaaatgtcagtgaactacagttgtgtgccattaagttagtcactgcagtattctcaagatatgaaaaacataggcagttaattttggaagaaatttttacttcacttgcaagattaccaaccagcaagaggagtttaaggaacttcaggttaaacagtagtgatatggatggagaacctatgtatattcagatggttacagcactggttttacaacttattcagtgtgtggtacacttaccatcatcagagaaggactctaatgcagaagaagattcaaataaaaaaattgaccaggatgttgtcattactaactcttatgaaacagctatgcgaacagcccaaaacttcctctccatcttccttaaaaaatgtggtagtaagcaaggtgaagaagattacagaccactgtttgaaaattttgttcaagaccttctttcaacagtcaataagcctgaatggccagctgctgaactactccttagtttgttagggagactgttggttcatcagttcagtaacaagtcaacagagatggctttaagagtggcatctcttgattaccttggaactgttgctgcacggctaagaaaagatgctgttacaagcaaaatggatcaaggatctatagaacgcattttaaaacaggtttcaggaggggaagatgaaatccaacaattacaaaaagcattgcttgattacttggatgaaaacactgagactgatccttcactagtgttttctcgtaaattctatatagcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagatgaactctgatactgtggactatgatgatgcttgcttgattgttcgatacttggcctccatgaggccgtttgcccagagctttgatatttatttgacacagatcctacgagttcttggtgaaaatgcaattgctgttcgaacaaaagccatgaagtgtttgtctgaggttgttgctgtagaccccagtattctagcaaggcttgatatgcaacgaggtgttcatggacgattgatggataattcgactagtgtccgagaagcagcagtagaattactaggtcgatttgtcctttgtcgacctcagcttgctgaacagtattatgatatgctgattgaaagaatattggatactggtatcagtgtcaggaaaagagtaataaagattctcagagacatttgtattgaacaaccaacatttccaaaaatcacagaaatgtgtgtaaaaatgattcgcagagtcaatgatgaagagggcattaagaaattagtaaatgaaacattccagaaactctggtttactccaactccacacaatgacaaagaagcaatgacaaggaaaattttaaacattaccgatgtggttgcagcatgcagagatactggatatgactggtttgagcaactgcttcaaaacttgttgaagtccgaagaggattcctcatataaacctgtgaagaaagcttgtactcaacttgttgataacctagttgagcacattcttaaatatgaggaatctctagctgactctgacaataaaggtgtgaattctggaagattggtagcttgcataaccactttgttcttattcagcaaaataagaccccagctcatggttaaacatgcaatgactatgcaaccataccttaccactaaatgtagtacgcaaaatgatttcatggttatctgcaatgttgcaaaaatcctagagctagttgtaccactgatggagcatccaagtgaaacttttcttgccactattgaggaagatctaatgaagctcatcatcaaatatggcatgactgtagtgcaacattgtgtgagctgtcttggagctgttgtaaataaagtgacacaaaattttaaatttgtgtgggcttgtttcaatagatactatggtgccatttcaaaattaaaaagtcaacaccaagaggacccaaataacacttcacttctaacaaacaaaccagcacttcttagatcccttttcaccgttggagcactatgtcggcattttgattttgatctggaagattttaaaggcaacagcaaggttaacataaaagataaagtacttgaactattgatgtattttacaaaacactcagatgaagaagtacaaacaaaagctatcattggtctaggatttgcctttattcagcatccaagtctaatgttcgagcaagaagtgaagaatctatataataatattttatctgataagaactcctcagtcaatttaaaaatacaagtgttaaaaaacctccagacctacctacaagaagaagatacacgtatgcagcaggcagatagagactggaagaaagttgcaaaacaggaagacttaaaagaaatgggtgatgtttcctcagggatgagtagttccatcatgcagctttatctcaaacaggtgcttgaggcattttttcacacccagtcaagtgtacgccactttgccctaaatgtcattgcattgactctaaatcaaggtcttattcatccagttcagtgtgtgccatatttaattgctatgggcacagacccagaacctgctatgcggaacaaggctgatcagcaacttgtggaaatagacaaaaaatatgctggattcattcatatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcaaaaacagacgtgactatgctcttgtatatagcagacaatctagcctgttttccataccagacacaggaagagccgttgtttataatgcatcatatagacattacactctcagtttctggtagtaacctactgcagtcattcaaggagtctatggtaaaggacaaaaggaaagagagaaaatcatcacctagtaaggaaaatgagtcaagcgacagtgaagaagaagtttccaggcctcggaagtcacggaaacgtgtagattcagattcagattcagattcagaagacgatataaattcagtgatgaaatgtttgccagaaaattcagctcctttaatcgaatttgcaaatgtgtcccagggtattttattacttctcatgttaaaacaacatttgaagaatctttgtggattttctgatagttcaaacttctcatggaacatctggaccctgatgaagaagaagaagaaggggaggtttcagctagcacaaatgctcggaacaaagcaattacctcactgcttggaggaggcagccctaaaaataatacagcagcagagacagaagatgatgaaagtgatggggaggatagaggaggaggcacttcaggggtgaggcggaggaggagtcaacgtatttcgcagcgtattacgtaaaatgatttttatgtgcttatatatgtcagtctattaaatgtacaccaagtaatgtaatacttaaaagagaaaacattttgtagatagagattctctacttacccgtttatacatccttttgtagaaagtttaacataaaagacaataaaaaaacagaaatgagatttatccagcataaagggttaatttttctttgaattgtattaatgtgtgttatttttattgttgctaagttttatgtagctatatggttcatatgtatatataattttatatatcaataagagtaaagacacgggtacaaattaagagttatatggttttacaagtatatgttaaccccttggcgctggcggtcacggtgcgtctcattgccggcaatggaagtgtgccgggaaatcccaactcccggcgtcaagggattaaaagcaataaaaacaataatttcactaaaattcttttgtgtaacacttggtcttttttcccccctcccaatgttttagtcattgagaaggtcaaaacgaaattcagactctacggagttggcagcacagatgaatgaaagtgttgacgtcatggatgtcatcgctatttgctgtccaaagtacaaagatcgaccacaaattgcaagagtagtgcagaaaaccagcagtggcttcagtgttcagtggatggcaggctcctacagtggctcctggactgaggctaagcgccgtgatggccgcaaactggtgccttgggtagacactattaaagagtcagacattatttacaaaaaaattgctctaacgagtgctaataagctgactaataaagttgttcagactttacgatccctgtatgccgccaaggatgggacttccagctaatgaatttgtacatgcagccaaatttacaggaatttttttaaaaggcagaaaaacttgaaataccaacattctggcaaaaaaaaatcagttttatgaagagtaagtggaacctgggatgcaggaacaaaagaaggaaatgttgggcaaacatttttgtgggagctcccttcgctgttgtgcagcagaaacagattctcagttcatttttactcccactgtattatagtttaacaaaaattgtttatatcttggaaaaaaaactttctgtttaaaaaaaataaacaagtgaatgttggaaattagtctgttaatgttcttaataaagtgttcttggagtttaacctagcagcggatggctttctttagcttagcccagtttccagggaagcattgttttttccaggctgtaaaatggcagaatctcctggatatataatttattctgttgaaaaaaaaaaaagcatgcagtatctatgacctatctgcagaaggagtttttgtaaatgtagattttgatgtattaggtcaccctgaaaacaatacaagaaaagggatccccaggtaatctggtggagcgaatactgcaataaatttttttacttctctttgtta

SEQ ID NO: 455139 - DNA, 3646 bp, Homo sapiens
taaaaagcatagtatttgcatataacctacatacatcctcccatatgctttaagtcatttctagattacttataatacctaatacaatgtaaatgctatatacatagttgttatactgcattttttttaagttgtattttttattgtaatgctgtttgttttgttttgagacggagtttcactcttgttgcccaggctggtctcaaactcctgacctcaggtgatccgccggcctcccaaagtgctgggattacaggcatgagccaccatacctggccagtgctgttattttttattgtggcattttccaaatagtttttgatccactgtgggttgaatccgcaggtgcggaatccggggatacagagggctatgtttttaattcagaaaaatacatggcttatatgtcataaaaggtaaaactgcaagcagtcattctcttaccgtgtttggctattctgttcctttcttttctgataaccaatattattactttttcgtatgttcttatatgagtaatgccaatatatatatatgtagattttctcacttatcaagtatgcaaatgtatgtatataaaatgtgctttaaaaatagagacagataatagactagaggttaccaaggaccggggaaggaaagaacggggagttattgtttaatgaggacagctgtggtttccagtgattaaaaaaaaaaagaaacagctctggaaatggacagtggtgatagttgtacaatatgccaatgaattatacatttaaaatggttaaactggtaggctggacatgctggcttatacctgtaatcttagcaccttgggaggcctatgtaggaggtttgcttgagtccaggaagtccaggccagcctgagcaacagggtgagaccctgtctctacaaaaaatacaaacattagccagacatggcggtgtgcacctgtagtcccaactgctggggaggctgaggtgggaggaccacctaagcctgggaggtggaggctacagtgagccatgatcgtgccactgcacttcagcctgagtgacagagtgagaccctgtctcaatttaaaaagaaaaaaaaaaagggttaagctggcaaattttatgatatttctattttatcacaatataaaagtttttaaaaatgtttttgaaattagaggactatcctaaaaaataaaaataaagttttatattttaatctacttaatttcaggtgtagtggctcacaagcactttgggaggctgaggtgggcagatcactcgaggccagaggtttgacaccagtttggccaacattgcaaaaccccatttctatttttcttaaaaaaatttttaaaaatctactttaaagcaagtagctgaacataaaataaggttttttgaactaagaatataatctacacagtggcttttcatattattcattgactgcaaaccttactctaaaatttaaaaatattttagttcttatttaaaatttttcaacattctttgctttctcttgtatcgtcttagcagagagcaaagaggggagataactagaaaatgtctatcagtaatatcacctgattgcttgatgacttggaccaagggtctgaaaactctggctgtttttgtatctaacccattgcctgtttttgcaaacaaagttttattgaaaacattcatgcccactcatttatttgtctgtagctgctttcatactacagtggcagagttgggtagttgtgacagactatttgaccttcaaaatgaaaaatatttaccacctggctgtttacagaaaatgtttactagcccctaatttagatgatggctaacgtctgtttcacccacaccaaactactgccatagaaaacatttaggaatttgacaatcttgcttgaaatatttacttaaaattctgaaataatatctgttttttgtagttcaaacttctcatggaacatctggaccctgatgaagaagaagaagaaggggaggtttcagctagcacaaatgctcggaacaaagcaattacctcactgcttggaggaggcagccctaaaaataatacagcagcagagacagaagatgatgaaagtgatggggaggatagaggaggaggcacttcaggggtgaggcggaggaggagtcaacgtatttcgcagcgtattacgtaaaatgatttttatgtgcttatatatgtcagtctattaaatgtacaccaagtaatgtaatacttaaaagagaaaacattttgtagatagagattctctacttacccgtttatacatccttttgtagaaagtttaacataaaagacaataaaaaaacagaaatgagatttatccagcataaagggttaatttttctttgaattgtattaatgtgtgttatttttattgttgctaagttttatgtagctatatggttcatatgtatatataattttatatatcaataagagtaaagacacgggtacaaattaagagttatatggttttacaagtatatgttaaccccttggcgctggcggtcacggtgcgtctcattgccggcaatggaagtgtgccgggaaatcccaactcccggcgtcaagggattaaaagcaataaaaacaataatttcactaaaattcttttgtgtaacacttggtcttttttcccccctcccaatgttttagtcattgagaaggtcaaaacgaaattcagactctacggagttggcagcacagatgaatgaaagtgttgacgtcatggatgtcatcgctatttgctgtccaaagtacaaagatcgaccacaaattgcaagagtagtgcagaaaaccagcagtggcttcagtgttcagtggatggcaggctcctacagtggctcctggactgaggctaagcgccgtgatggccgcaaactggtgccttgggtagacactattaaagagtcagacattatttacaaaaaaattgctctaacgagtgctaataagctgactaataaagttgttcagactttacgatccctgtatgccgccaaggatgggacttccagctaatgaatttgtacatgcagccaaatttacaggaatttttttaaaaggcagaaaaacttgaaataccaacattctggcaaaaaaaaatcagttttatgaagagtaagtggaacctgggatgcaggaacaaaagaaggaaatgttgggcaaacatttttgtgggagctcccttcgctgttgtgcagcagaaacagattctcagttcatttttactcccactgtattatagtttaacaaaaattgtttatatcttggaaaaaaaactttctgtttaaaaaaaataaacaagtgaatgttggaaattagtctgttaatgttcttaataaagtgttcttggagtttaacctagcagcggatggctttctttagcttagcccagtttccagggaagcattgttttttccaggctgtaaaatggcagaatctcctggatatataatttattctgttgaaaaaaaaaaaagcatgcagtatctatgacctatctgcagaaggagtttttgtaaatgtagattttgatgtattaggtcaccctgaaaacaatacaagaaaagggatccccaggtaatctggtggagcgaatactgcaataaatttttttacttctctttgtta

SEQ ID NO: 455140 - DNA, 2477 bp, Homo sapiens
tcccttggtctctctgtgtctctccccactctctccgtgtgtgtctgcttatctctgtctaacattaagtgaggtgaaagtgccctgtattttttctaaaaaaggtttttggttgggtttctagattatccgctaaacatgtgtgctttttcttaaaatttacagaaaacagacgtgactatgctcttgtatatagcagacaatctagcctgttttccataccagacacaggaagagccgttgtttataatgcatcatatagacattacactctcagtttctggtagtaacctactgcagtcattcaaggagtctatggtaaaggacaaaaggaaagagagaaaatcatcacctagtaaggaaaatgagtcaagcgacagtgaagaagaagtttccaggcctcggaagtcacggaaacgtgtagattcagattcagattcagattcagaagacgatataaattcagtgatgaaatgtttgccagaaaattcagctcctttaatcgaatttgcaaatgtgtcccagggtattttattacttctcatgttaaaacaacatttgaagaatctttgtggattttctgatagtaaaattcagaagtactctccatctgaatctgcaaaagtatatgataaagcgataaaccgaaaaacaggagttcattttcatccaaaacaaacactggacttcctgcggagtgacatggctaattccaaaatcacagaagaggtgaaaaggagtatagtaaaacagtatctagatttcaaacttctcatggaacatctggaccctgatgaagaagaagaagaaggggaggtttcagctagcacaaatgctcggaacaaagcaattacctcactgcttggaggaggcagccctaaaaataatacagcagcagagacagaagatgatgaaagtgatggggaggatagaggaggaggcacttcaggggtgaggcggaggaggagtcaacgtatttcgcagcgtattacgtaaaatgatttttatgtgcttatatatgtcagtctattaaatgtacaccaagtaatgtaatacttaaaagagaaaacattttgtagatagagattctctacttacccgtttatacatccttttgtagaaagtttaacataaaagacaataaaaaaacagaaatgagatttatccagcataaagggttaatttttctttgaattgtattaatgtgtgttatttttattgttgctaagttttatgtagctatatggttcatatgtatatataattttatatatcaataagagtaaagacacgggtacaaattaagagttatatggttttacaagtatatgttaaccccttggcgctggcggtcacggtgcgtctcattgccggcaatggaagtgtgccgggaaatcccaactcccggcgtcaagggattaaaagcaataaaaacaataatttcactaaaattcttttgtgtaacacttggtcttttttcccccctcccaatgttttagtcattgagaaggtcaaaacgaaattcagactctacggagttggcagcacagatgaatgaaagtgttgacgtcatggatgtcatcgctatttgctgtccaaagtacaaagatcgaccacaaattgcaagagtagtgcagaaaaccagcagtggcttcagtgttcagtggatggcaggctcctacagtggctcctggactgaggctaagcgccgtgatggccgcaaactggtgccttgggtagacactattaaagagtcagacattatttacaaaaaaattgctctaacgagtgctaataagctgactaataaagttgttcagactttacgatccctgtatgccgccaaggatgggacttccagctaatgaatttgtacatgcagccaaatttacaggaatttttttaaaaggcagaaaaacttgaaataccaacattctggcaaaaaaaaatcagttttatgaagagtaagtggaacctgggatgcaggaacaaaagaaggaaatgttgggcaaacatttttgtgggagctcccttcgctgttgtgcagcagaaacagattctcagttcatttttactcccactgtattatagtttaacaaaaattgtttatatcttggaaaaaaaactttctgtttaaaaaaaataaacaagtgaatgttggaaattagtctgttaatgttcttaataaagtgttcttggagtttaacctagcagcggatggctttctttagcttagcccagtttccagggaagcattgttttttccaggctgtaaaatggcagaatctcctggatatataatttattctgttgaaaaaaaaaaaagcatgcagtatctatgacctatctgcagaaggagtttttgtaaatgtagattttgatgtattaggtcaccctgaaaacaatacaagaaaagggatccccaggtaatctggtggagcgaatactgcaataaatttttttacttctctttgtta

SEQ ID NO: 455141 - DNA, 6075 bp, Homo sapiens
  misc_feature (6054)..(6054): n is a, c, g, or t
cagcatcggtatcaagtcccattgttgcaggtggtttgagaaacatacatgataataaagtttctggtccgttgtctggcaattcagctaatcatcatgctgataatcctagacatggttcaagtgaggactacctacacatggtgcacaggctaagtagtgacgatggagattcttcaacaatgaggaatgctgcatcttttcccttgagatctccacagccagtatgctcccctgctggaagtgaaggaactcctaaaggctcaagaccacctttaatcctacaatctcagtctctaccttgttcatcacctcgagatgttccaccagatatcttgctagattctccagaaagaaaacaaaagaagcagaagaaaatgaaattaggcaaggatgaaaaagagcagagtgagaaagcggcaatgtatgatataattagttctccatccaaggactctactaaacttacattaagactttctcgtgtaaggtcttcagacatggaccagcaagaggatatgatttctggtgtggaaaatagcaatgtttcagaaaatgatattccttttaatgtgcagtacccaggacagacttcaaaaacacccattactccacaagatataaaccgcccactaaatgctgctcaatgtttgtcgcagcaagaacaaacagcattccttccagcaaatcaagtgcctgttttacaacagaacacttcagttgctgcaaaacaaccccagacttctgtggtacagaatcaacaacagatatcacaacagggacctatatatgatgaagtggaattggatgcattggctgaaattgagcgaatagagagagaatcagctattgaaagggagcgcttctcaaaagaagttcaagataaagataagcctttgaaaaaaagaaaacaagattcttacccacaggaggctgggggtgctacaggaggtaatagaccagcttctcaggagacgggttctacgggaaatgggtcaaggccagcattaatggttagcattgatcttcatcaggcaggaagagtggactctcaggcttctataactcaggattcagactccataaaaaagcctgaagaaatcaaacaatgtaatgatgcacctgtttctgttcttcaggaagatattgttggaagtcttaaatctacaccagaaaaccatcctgagacacctaaaaaaaagtctgatcctgagctttcaaagagtgaaatgaaacaaagtgaaagtagattagcagaatctaaaccaaatgaaaaccgattggtggagacaaaatcaagtgaaaataagttagaaactaaagttgagacccaaacagaagaacttaaacagaatgagagcagaacaactgaatgcaaacaaaacgagagcaccatagttgagcctaaacaaaatgaaaatagactgtctgacacaaaaccaaatgacaacaaacaaaataatggcagatcagaaacaacaaaatcaaggcctgaaaccccaaagcaaaagggtgaaagccggcctgagactccaaaacaaaagagtgatgggcatcctgaaaccccaaaacagaagggtgatggaaggcctgaaactccaaagcaaaaaggtgagagccgccctgaaactccaaagcaaaaaaatgaagggcgacctgaaacaccaaaacacaggcatgacaataggagggattctggaaagccatctacagagaaaaaacctgaagtgtctaaacataaacaagatactaaatctgactcacctcggttaaaatcagaacgagctgaagccttaaagcagagacctgatgggcgatctgtttctgagtcactaagacgtgaccatgataataaacaaaaatcagatgacaggggtgaatcagagcgacatcgaggggatcagtctagggttcgaagaccagaaacattgagatcctctagtagaaatgaacatggcattaaatctgatagttcaaaaactgataaactagaacgaaaacacaggcatgaatcaggggactcaagggaaagaccatcttctggggaacaaaaatcaagacctgacagtcctcgtgttaaacaaggagattctaataaatcaagatctgataaacttggttttaaatcaccaactagtaaagatgacaaaaggacagagggtaacaagagtaaagtagacactaataaagcacaccctgacaataaggcagaatttccaagttatttgttggggggcaggtctggtgcgttgaaaaattttgtcattccgaaaatcaagagggataaagatggcaatgttactcaggagacaaagaaaatggaaatgaaaggagagccgaaagacaaagtagaaaaaataggattagttgaagatctaaataaaggagctaagcctgtagttgtgctacaaaaactgtctttggatgatgttcagaaacttattaaagatagagaggacaaatcaagaagttcccttaaacctatcaagaataaaccatcaaagtcaaataaaggtagtatagatcaatcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatcctctaggaaacgacataaaaaagatgatgataaagcttgggaatatgaagagcgtgacagaagaagctctggggatcataggagaagtggccactctcatgaaggaagaaggagttcaggtggtggtcgttatcgaaaccgaagtccgtcagattctgacatggaagattattctcctcctcccagccttagtgaggttgctaggaaaatgaagaaaaaagaaaaacagaagaaaaggaaagcatatgaaccaaaactaacacctgaagaaatgatggactcttcaacttttaagagattcacagcctcaatagagaatattttggataatttggaagatatggattttactgcgtttggtgatgatgatgaaattcctcaggaactgctcttaggaaaacatcagcttaatgaacttggcagtgaatctgctaaaataaaagcaatgggtataatggataagctttcaactgacaaaactgtgaaagtcttaaatatcttggagaagaatattcaggatgggtcaaagctttccactttgttaaatcataataacgatactgaagaagaagaaaggttatggagagaccttattatggagagagttacaaaatcagcggatgcttgtcttacaactatcaacattatgacatcccctaacatgccaaaagctgtgtacattgaggatgtaattgaaagagttatacagtacactaaatttcatttgcagaatacactttatcctcagtatgatcctgtttacagattagatcctcatggaggaggcttattaagttcaaaagcaaaacgggctaaatgttctacccataagcagagagtaatagtaatgctttataacaaagtttgtgacattgttagcagcttatcagaattgctagagatacaacttcttacagacacaacaattcttcaggtttcatctatgggaataacaccattttttgtggaaaatgtcagtgaactacagttgtgtgccattaagttagtcactgcagtattctcaagatatgaaaaacataggcagttaattttggaagaaatttttacttcacttgcaagattaccaaccagcaagaggagtttaaggaacttcaggttaaacagtagtgatatggatggagaacctatgtatattcagatggttacagcactggttttacaacttattcagtgtgtggtacacttaccatcatcagagaaggactctaatgcagaagaagattcaaataaaaaaattgaccaggatgttgtcattactaactcttatgaaacagctatgcgaacagcccaaaacttcctctccatcttccttaaaaaatgtggtagtaagcaaggtgaagaagattacagaccactgtttgaaaattttgttcaagaccttctttcaacagtcaataagcctgaatggccagctgctgaactactccttagtttgttagggagactgttggttcatcagttcagtaacaagtcaacagagatggctttaagagtggcatctcttgattaccttggaactgttgctgcacggctaagaaaagatgctgttacaagcaaaatggatcaaggatctatagaacgcattttaaaacaggtttcaggaggggaagatgaaatccaacaattacaaaaagcattgcttgattacttggatgaaaacactgagactgatccttcactagtgttttctcgtaaattctatatagcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagatgaactctgatactgtggactatgatgatgcttgcttgattgttcgatacttggcctccatgaggccgtttgcccagagctttgatatttatttgacacagatcctacgagttcttggtgaaaatgcaattgctgttcgaacaaaagccatgaagtgtttgtctgaggttgttgctgtagaccccagtattctagcaaggcttgatatgcaacgaggtgttcatggacgattgatggataattcgactagtgtccgagaagcagcagtagaattactaggtcgatttgtcctttgtcgacctcagcttgctgaacagtattatgatatgctgattgaaagaatattggatactggtatcagtgtcaggaaaagagtaataaagattctcagagacatttgtattgaacaaccaacatttccaaaaatcacagaaatgtgtgtaaaaatgattcgcagagtcaatgatgaagagggcattaagaaattagtaaatgaaacattccagaaactctggtttactccaactccacacaatgacaaagaagcaatgacaaggaaaattttaaacattaccgatgtggttgcagcatgcagagatactggatatgactggtttgagcaactgcttcaaaacttgttgaagtccgaagaggattcctcatataaacctgtgaagaaagcttgtactcaacttgttgataacctagttgagcacattcttaaatatgaggaatctctagctgactctgacaataaaggtgtgaattctggaagattggtagcttgcataaccactttgttcttattcagcaaaataagaccccagctcatggttaaacatgcaatgactatgcaaccataccttaccactaaatgtagtgtgtttacatatttcctttggatcaccactacaaacaatttttaaataaacattccaatttaaatacctaaaaaaaaaaaaaaaaaaaaaaaaaaaaaaaaaaaaaaaaagaagaggggggagcgggaaaaaaaaaaaaagggggggcaaaagaaaaagagaaaacaagaggggaaaagggggccccaaaagagagagccgactaaataataacgaccagcgcacggggccgccggtttaaaacaccacgcgcgaggaagggggaaccaacactgggcacacgtggggaaccccttcggacagggacccatcacgcttccggagggggggggacacaaaatgtgggacacaacattatacccccaacagaaaagtaattataaaagggcctcataggggaggaacaatattgaaaacttttgaacagggggggtaataaagggggggtaaaaccaataaggcgcggaacattattcgtggcgtgcctggaaaaaattttgggaagacagaggagtagtgacttttcggaacataatattatcacggggagggngtatgaaaaaacagaaatata

SEQ ID NO: 455142 - DNA, 3237 bp, Homo sapiens
cagcatcggtatcaagtcccattgttgcaggtggtttgagaaacatacatgataataaagtttctggtccgttgtctggcaattcagctaatcatcatgctgataatcctagacatggttcaagtgaggactacctacacatggtgcacaggctaagtagtgacgatggagattcttcaacaatgaggaatgctgcatcttttcccttgagatctccacagccagtatgctcccctgctggaagtgaaggaactcctaaaggctcaagaccacctttaatcctacaatctcagtctctaccttgttcatcacctcgagatgttccaccagatatcttgctagattctccagaaagaaaacaaaagaagcagaagaaaatgaaattaggcaaggatgaaaaagagcagagtgagaaagcggcaatgtatgatataattagttctccatccaaggactctactaaacttacattaagactttctcgtgtaaggtcttcagacatggaccagcaagaggatatgatttctggtgtggaaaatagcaatgtttcagaaaatgatattccttttaatgtgcagtacccaggacagacttcaaaaacacccattactccacaagatataaaccgcccactaaatgctgctcaatgtttgtcgcagcaagaacaaacagcattccttccagcaaatcaagtgcctgttttacaacagaacacttcagttgctgcaaaacaaccccagacttctgtggtacagaatcaacaacagatatcacaacagggacctatatatgatgaagtggaattggatgcattggctgaaattgagcgaatagagagagaatcagctattgaaagggagcgcttctcaaaagaagttcaagataaagataagcctttgaaaaaaagaaaacaagattcttacccacaggaggctgggggtgctacaggaggtaatagaccagcttctcaggagacgggttctacgggaaatgggtcaaggccagcattaatggttagcattgatcttcatcaggcaggaagagtggactctcaggcttctataactcaggattcagactccataaaaaagcctgaagaaatcaaacaatgtaatgatgcacctgtttctgttcttcaggaagatattgttggaagtcttaaatctacaccagaaaaccatcctgagacacctaaaaaaaagtctgatcctgagctttcaaagagtgaaatgaaacaaagtgaaagtagattagcagaatctaaaccaaatgaaaaccgattggtggagacaaaatcaagtgaaaataagttagaaactaaagttgagacccaaacagaagaacttaaacagaatgagagcagaacaactgaatgcaaacaaaacgagagcaccatagttgagcctaaacaaaatgaaaatagactgtctgacacaaaaccaaatgacaacaaacaaaataatggcagatcagaaacaacaaaatcaaggcctgaaaccccaaagcaaaagggtgaaagccggcctgagactccaaaacaaaagagtgatgggcatcctgaaaccccaaaacagaagggtgatggaaggcctgaaactccaaagcaaaaaggtgagagccgccctgaaactccaaagcaaaaaaatgaagggcgacctgaaacaccaaaacacaggcatgacaataggagggattctggaaagccatctacagagaaaaaacctgaagtgtctaaacataaacaagatactaaatctgactcacctcggttaaaatcagaacgagctgaagccttaaagcagagacctgatgggcgatctgtttctgagtcactaagacgtgaccatgataataaacaaaaatcagatgacaggggtgaatcagagcgacatcgaggggatcagtctagggttcgaagaccagaaacattgagatcctctagtagaaatgaacatggcattaaatctgatagttcaaaaactgataaactagaacgaaaacacaggcatgaatcaggggactcaagggaaagaccatcttctggggaacaaaaatcaagacctgacagtcctcgtgttaaacaaggagattctaataaatcaagatctgataaacttggttttaaatcaccaactagtaaagatgacaaaaggacagagggtaacaagagtaaagtagacactaataaagcacaccctgacaataaggcagaatttccaagttatttgttggggggcaggtctggtgcgttgaaaaattttgtcattccgaaaatcaagagggataaagatggcaatgttactcaggagacaaagaaaatggaaatgaaaggagagccgaaagacaaagtagaaaaaataggattagttgaagatctaaataaaggagctaagcctgtagttgtgctacaaaaactgtctttggatgatgttcagaaacttattaaagatagagaggacaaatcaagaagttcccttaaacctatcaagaataaaccatcaaagtcaaataaaggtagtatagatcaatcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatagctggcttcttcactacacagctacctctctacaacactgtgatcacctgtctttgcactagacttgctatacctcgcctgtcttcctactggtccactgaaaaagttcttctcttttatccctatcttccttcttctggagcaagagaattgagcctagccaagaggggtcagcaaccttgtttgacttaaacggcattcagtggaaacagactatgggagatcttcacttgtgtgccaactgacttagtcataatgaccaaaagaagtgggaagaccaccagtgttctactttttccacctagtgtccatagattgaggtgtgacaagcaagggcaggaaggacagatgcatgctgccatttttaaatgtatattgctgatggaagcccttcacctcctccaaagtttttaatgttaatttactgatttttttttaattgtgagctcttgagctatgagcagtagactatgaatactgaacaaatctgaaaaaagttttaaaattgaaataaaatatacagcaaacttaacatttaa

SEQ ID NO: 455143 - DNA, 353 bp, Homo sapiens
tcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatgtaagtatcacagaactctttgttattattttagagtttaaaagcaggttgatgtgtttttctcatttataatttgggggtttagcaaaagcacagtcaccttaattcttaataacacagtatagtaagttttttttctctatactttaaaaatgcgtgaaagatgagatcagttggcaccaag

SEQ ID NO: 455144 - DNA, 353 bp, Homo sapiens
ggagttcaggtggtggtcgttatcgaaaccgaagtccgtcagattctgacatggaagattattctcctcctcccagccttagtgagggtaattcatcagtgtcaacggatttcttacataaaccaatttaaatttagggctttaactttgaagaatattttatatctttttatgagttaataactaattttcaattaagacaaaaatacttagtttctatgtgcagtgattatcgtttaagtctttaacgttcaggaaaaaaactagaaacaaaaatggaattattttaagttgtcagtcctgcatttcagtacttctttttgttcgttttagttgctaggaaaatgaagaaa

SEQ ID NO: 455145 - DNA, 315 bp, Homo sapiens
ggtaaatggttgtgttactgaaaaaatagtttactttaaaaataaacttttgaattgagaaaattgaaacatgtttcaggctaaagcataacaaaagtatattttattcacatttataaatatacttctaactttgattcttttcatcacccttaggttgcagcatgcagagatactggatatgactggtttgagcaactgcttcaaaacgtgagtgttcttttgactcctgataacctaaaatttaataggttagttttttgttgttggtgtttttttttttttggactgtatgatttaaaagaacctttttag

SEQ ID NO: 455146 - DNA, 141 bp, Homo sapiens
agtgaatatactgcgtatggatacttattttctaatttcatacactaggcatctcaatttttctgactcttaaaaatacctttctgtttttaggatactggtatcagtgtcaggaaaagagtaataaagattctcagagac

SEQ ID NO: 455147 - DNA, 493 bp, Homo sapiens
ttaatataagtattggaacatagtaaaataataagttttctaacatttaggatattctatattttctggctttcttaaaatctgtttttatcacatggaagttgttttaaagtaaactttaatatttgtattcctgtaatgtgagcactctaactttattaacttggaaatcttgttgctaatttcatcaagctcaagtctgtctaatttctttccagttttctcgtaaattctatatagcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagtaagatccaaggagaaaacagtttacatttatctccttgatatctatttccctaagtta

SEQ ID NO: 455148 - DNA, 733 bp, Homo sapiens
gtacagctattatgtatccataaaaaaaaaattttaagtttagtcctaaattcattagtaaatttacatttatatataataatatgtataattgtcccttttttttaagtttagcaaacactgtaacaacttcttctccaaaagcagtaaatatattttttagtttgatcataaacatttgagtgtatagtatgaagaagttctaggctagggatagtatcacccattcgtattgtttaaaatctttaccaaattgaaaatttttatagttttgagaaattagtagttttagaaaaaactgaggaaattaataccagaaattcctggcagtttgtgttttgattagttatttatagctttgtgttgggcctaatgagaatttggaattgtgaaattgccgtatttgttataattagttaatttgaaatttctcttccttctagaaattagtaaatgaaacattccagaaactctggtttactccaactccacacaatgacaaagaagcaatgacaaggaaaattttaaacattaccgatgtggtaagaaggactggaacaagggtgtggtcactgttgatccagacctaattgaggcctacatgtcttatgaaggaagagacaataatgagatatttcattaatcttgacatttcgtactgctgcctttactttatatttctggagatgctgaagggatgcaagtaacatgtcgttgatgcttccatatagcc

SEQ ID NO: 455149 - DNA, 8982 bp, Homo sapiens
cattagggaaaacataaagtggctgaatttacaaattattggtatccccaagcacaaagaaaggattagaaaacctatttaacaaagtaatgatgaaaactctcaagatctagcaagacatagagacattcagatataggagacacaatgatccctaggaagatacagtgcaaaaaaggtcttctcaacaaggcattataatcagactctctaaagtcaaagataagagtgaatcctaaaaatagcaagaaaaaagcatgtagctacctataaaggaaaccccatcaaactaacagtagatttttcagcagaaaccttacagctcgtgccgaattcggcacgaggtttgtcgcagcaagaacaaacagcattccttccagcaaatcaagtgcctgttttacaacagaacacttcagttgctgcaaaacaaccccagacttctgtggtacagaatcaacaacagatatcacaacagggacctatatatgatgaagtggaattggatgcattggctgaaattgagcgaatagagagagaatcagctattgaaagggagcgcttctcaaaagaagttcaagataaagataagcctttgaaaaaaagaaaacaagattcttacccacaggaggctgggggtgctacaggaggtaatagaccagcttctcaggagacgggttctacgggaaatgggtcaaggccagcattaatggttagcattgatcttcatcaggcaggaagagtggactctcaggcttctataactcaggattcagactccataaaaaagcctgaagaaatcaaacaatgtaatgatgcacctgtttctgttcttcaggaagatattgttggaagtcttaaatctacaccagaaaaccatcctgagacacctaaaaaaaagtctgatcctgagctttcaaagagtgaaatgaaacaaagtgaaagtagattagcagaatctaaaccaaatgaaaaccgattggtggagacaaaatcaagtgaaaataagttagaaactaaagttgagacccaaacagaagaacttaaacagaatgagagcagaacaactgaatgcaaacaaaacgagagcaccatagttgagcctaaacaaaatgaaaatagactgtctgacacaaaaccaaatgacaacaaacaaaataatggcagatcagaaacaacaaaatcaaggcctgaaaccccaaagcaaaagggtgaaagccggcctgagactccaaaacaaaagagtgatgggcatcctgaaaccccaaaacagaagggtgatggaaggcctgaaactccaaagcaaaaaggtgagagccgccctgaaactccaaagcaaaaaaatgaagggcgacctgaaacaccaaaacacaggcatgacaataggagggattctggaaagccatctacagagaaaaaacctgaagtgtctaaacataaacaagatactaaatctgactcacctcggttaaaatcagaacgagctgaagccttaaagcagagacctgatgggcgatctgtttctgagtcactaagacgtgaccatgataataaacaaaaatcagatgacaggggtgaatcagagcgacatcgaggggatcagtctagggttcgaagaccagaaacattgagatcctctagtagaaatgaacatggcattaaatctgatagttcaaaaactgataaactagaacgaaaacacaggcatgaatcaggggactcaagggaaagaccatcttctggggaacaaaaatcaagacctgacagtcctcgtgttaaacaaggagattctaataaatcaagatctgataaacttggttttaaatcaccaactagtaaagatgacaaaaggacagagggtaacaagagtaaagtagacactaataaagcacaccctgacaataaggcagaatttccaagttatttgttggggggcaggtctggtgcgttgaaaaattttgtcattccgaaaatcaagagggataaagatggcaatgttactcaggagacaaagaaaatggaaatgaaaggagagccgaaagacaaagtagaaaaaataggattagttgaagatctaaataaaggagctaagcctgtagttgtgctacaaaaactgtctttggatgatgttcagaaacttattaaagatagagaggacaaatcaagaagttcccttaaacctatcaagaataaaccatcaaagtcaaataaaggtagtatagatcaatcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatcctctaggaaacgacataaaaaagatgatgataaagcttgggaatatgaagagcgtgacagaagaagctctggggatcataggagaagtggccactctcatgaaggaagaaggagttcaggtggtggtcgttatcgaaaccgaagtccgtcagattctgacatggaagattattctcctcctcccagccttagtgaggttgctaggaaaatgaagaaaaaagaaaaacagaagaaaaggaaagcatatgaaccaaaactaacacctgaagaaatgatggactcttcaacttttaagagattcacagcctcaatagagaatattttggataatttggaagatatggattttactgcgtttggtgatgatgatgaaattcctcaggaactgctcttaggaaaacatcagcttaatgaacttggcagtgaatctgctaaaataaaagcaatgggtataatggataagctttcaactgacaaaactgtgaaagtcttaaatatcttggagaagaatattcaggatgggtcaaagctttccactttgttaaatcataataacgatactgaagaagaagaaaggttatggagagaccttattatggagagagttacaaaatcagcggatgcttgtcttacaactatcaacattatgacatcccctaacatgccaaaagctgtgtacattgaggatgtaattgaaagagttatacagtacactaaatttcatttgcagaatacactttatcctcagtatgatcctgtttacagattagatcctcatggaggaggcttattaagttcaaaagcaaaacgggctaaatgttctacccataagcagagagtaatagtaatgctttataacaaagtttgtgacattgttagcagcttatcagaattgctagagatacaacttcttacagacacaacaattcttcaggtttcatctatgggaataacaccattttttgtggaaaatgtcagtgaactacagttgtgtgccattaagttagtcactgcagtattctcaagatatgaaaaacataggcagttaattttggaagaaatttttacttcacttgcaagattaccaaccagcaagaggagtttaaggaacttcaggttaaacagtagtgatatggatggagaacctatgtatattcagatggttacagcactggttttacaacttattcagtgtgtggtacacttaccatcatcagagaaggactctaatgcagaagaagattcaaataaaaaaattgaccaggatgttgtcattactaactcttatgaaacagctatgcgaacagcccaaaacttcctctccatcttccttaaaaaatgtggtagtaagcaaggtgaagaagattacagaccactgtttgaaaattttgttcaagaccttctttcaacagtcaataagcctgaatggccagctgctgaactactccttagtttgttagggagactgttggttcatcagttcagtaacaagtcaacagagatggctttaagagtggcatctcttgattaccttggaactgttgctgcacggctaagaaaagatgctgttacaagcaaaatggatcaaggatctatagaacgcattttaaaacaggtttcaggaggggaagatgaaatccaacaattacaaaaagcattgcttgattacttggatgaaaacactgagactgatccttcactagtgttttctcgtaaattctatatagcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagatgaactctgatactgtggactatgatgatgcttgcttgattgttcgatacttggcctccatgaggccgtttgcccagagctttgatatttatttgacacagatcctacgagttcttggtgaaaatgcaattgctgttcgaacaaaagccatgaagtgtttgtctgaggttgttgctgtagaccccagtattctagcaaggcttgatatgcaacgaggtgttcatggacgattgatggataattcgactagtgtccgagaagcagcagtagaattactaggtcgatttgtcctttgtcgacctcagcttgctgaacagtattatgatatgctgattgaaagaatattggatactggtatcagtgtcaggaaaagagtaataaagattctcagagacatttgtattgaacaaccaacatttccaaaaatcacagaaatgtgtgtaaaaatgattcgcagagtcaatgatgaagagggcattaagaaattagtaaatgaaacattccagaaactctggtttactccaactccacacaatgacaaagaagcaatgacaaggaaaattttaaacattaccgatgtggttgcagcatgcagagatactggatatgactggtttgagcaactgcttcaaaacttgttgaagtccgaagaggattcctcatataaacctgtgaagaaagcttgtactcaacttgttgataacctagttgagcacattcttaaatatgaggaatctctagctgactctgacaataaaggtgtgaattctggaagattggtagcttgcataaccactttgttcttattcagcaaaataagaccccagctcatggttaaacatgcaatgactatgcaaccataccttaccactaaatgtagtacgcaaaatgatttcatggttatctgcaatgttgcaaaaatcctagagctagttgtaccactgatggagcatccaagtgaaacttttcttgccactattgaggaagatctaatgaagctcatcatcaaatatggcatgactgtagtgcaacattgtgtgagctgtcttggagctgttgtaaataaagtgacacaaaattttaaatttgtgtgggcttgtttcaatagatactatggtgccatttcaaaattaaaaagtcaacaccaagaggacccaaataacacttcacttctaacaaacaaaccagcacttcttagatcccttttcaccgttggagcactatgtcggcattttgattttgatctggaagattttaaaggcaacagcaaggttaacataaaagataaagtacttgaactattgatgtattttacaaaacactcagatgaagaagtacaaacaaaagctatcattggtctaggatttgcctttattcagcatccaagtctaatgttcgagcaagaagtgaagaatctatataataatattttatctgataagaactcctcagtcaatttaaaaatacaagtgttaaaaaacctccagacctacctacaagaagaagatacacgtatgcagcaggcagatagagactggaagaaagttgcaaaacaggaagacttaaaagaaatgggtgatgtttcctcagggatgagtagttccatcatgcagctttatctcaaacaggtgcttgaggcattttttcacacccagtcaagtgtacgccactttgccctaaatgtcattgcattgactctaaatcaaggtcttattcatccagttcagtgtgtgccatatttaattgctatgggcacagacccagaacctgctatgcggaacaaggctgatcagcaacttgtggaaatagacaaaaaatatgctggattcattcatatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcaaaaacagacgtgactatgctcttgtatatagcagacaatctagcctgttttccataccagacacaggaagagccgttgtttataatgcatcatatagacattacactctcagtttctggtagtaacctactgcagtcattcaaggagtctatggtaaaggacaaaaggaaagagagaaaatcatcacctagtaaggaaaatgagtcaagcgacagtgaagaagaagtttccaggcctcggaagtcacggaaacgtgtagattcagattcagattcagattcagaagacgatataaattcagtgatgaaatgtttgccagaaaattcagctcctttaatcgaatttgcaaatgtgtcccagggtattttattacttctcatgttaaaacaacatttgaagaatctttgtggattttctgatagtaaaattcagaagtactctccatctgaatctgcaaaagtatatgataaagcgataaaccgaaaaacaggagttcattttcatccaaaacaaacactggacttcctgcggagtgacatggctaattccaaaatcacagaagaggtgaaaaggagtatagtaaaacagtatctagatttcaaacttctcatggaacatctggaccctgatgaagaagaagaagaaggggaggtttcagctagcacaaatgctcggaacaaagcaattacctcactgcttggaggaggcagccctaaaaataatacagcagcagagacagaagatgatgaaagtgatggggaggatagaggaggaggcacttcaggggtgaggcggaggaggagtcaacgtatttcgcagcgtattacgtaaaatgatttttatgtgcttatatatgtcagtctattaaatgtacaccaagtaatgtaatacttaaaagagaaaacattttgtagatagagattctctacttacccgtttatacatccttttgtagaaagtttaacataaaagacaataaaaaaacagaaatgagatttatccagcataaagggttaatttttctttgaattgtattaatgtgtgttatttttattgttgctaagttttatgtagctatatggttcatatgtatatataattttatatatcaataagagtaaagacacgggtacaaattaagagttatatggttttacaagtatatgttaaccccttggcgctggcggtcacggtgcgtctcattgccggcaatggaagtgtgccgggaaatcccaactcccggcgtcaagggattaaaagcaataaaaacaataatttcactaaaattcttttgtgtaacacttggtcttttttcccccctcccaatgttttagtcattgagaaggtcaaaacgaaattcagactctacggagttggcagcacagatgaatgaaagtgttgacgtcatggatgtcatcgctatttgctgtccaaagtacaaagatcgaccacaaattgcaagagtagtgcagaaaaccagcagtggcttcagtgttcagtggatggcaggctcctacagtggctcctggactgaggctaagcgccgtgatggccgcaaactggtgccttgggtagacactattaaagagtcagacattatttacaaaaaaattgctctaacgagtgctaataagctgactaataaagttgttcagactttacgatccctgtatgccgccaaggatgggacttccagctaatgaatttgtacatgcagccaaatttacaggaatttttttaaaaggcagaaaaacttgaaataccaacattctggcaaaaaaaaatcagttttatgaagagtaagtggaacctgggatgcaggaacaaaagaaggaaatgttgggcaaacatttttgtgggagctcccttcgctgttgtgcagcagaaacagattctcagttcatttttactcccactgtattatagtttaacaaaaattgtttatatcttggaaaaaaaactttctgtttaaaaaaaataaacaagtgaatgttggaaattagtctgttaatgttcttaataaagtgttcttggagtttaacctagcagcggatggctttctttagcttagcccagtttccagggaagcattgttttttccaggctgtaaaatggcagaatctcctggatatataatttattctgttgaaaaaaaaaaaagcatgcagtatctatgacctatctgcagaaggagtttttgtaaatgtagattttgatgtattaggtcaccctgaaaacaatacaagaaaagggatccccaggtaatctggtggagcgaatactgcaataaatttttttacttctctttgttacttgtctgtttccatttgaatttcttattgtaaaaatctgtttaaatccatttatattattttacagtcttttatgtaaaatttattatatcactggttttcaaagcaaaacataaaatattgtttatacagtttgtataggctgacttctgaataattggtatctattattttcattcccataagagggtgtaaacaattaactccagggttttattgtatcctgcaatatttagtattaactatatatgatttagcactgtgccaaacacattttcaagagtacattttgatataaaaagaaactattgtttattc

SEQ ID NO: 455150 - DNA, 8284 bp, Homo sapiens
cattagggaaaacataaagtggctgaatttacaaattattggtatccccaagcacaaagaaaggattagaaaacctatttaacaaagtaatgatgaaaactctcaagatctagcaagacatagagacattcagatataggagacacaatgatccctaggaagatacagtgcaaaaaaggtcttctcaacaaggcattataatcagactctctaaagtcaaagataagagtgaatcctaaaaatagcaagaaaaaagcatgtagctacctataaaggaaaccccatcaaactaacagtagatttttcagcagaaaccttacagctcgtgccgaattcggcacgaggtttgtcgcagcaagaacaaacagcattccttccagcaaatcaagtgcctgttttacaacagaacacttcagttgctgcaaaacaaccccagacttctgtggtacagaatcaacaacagatatcacaacagggacctatatatgatgaagtggaattggatgcattggctgaaattgagcgaatagagagagaatcagctattgaaagggagcgcttctcaaaagaagttcaagataaagataagcctttgaaaaaaagaaaacaagattcttacccacaggaggctgggggtgctacaggaggtaatagaccagcttctcaggagacgggttctacgggaaatgggtcaaggccagcattaatggttagcattgatcttcatcaggcaggaagagtggactctcaggcttctataactcaggattcagactccataaaaaagcctgaagaaatcaaacaatgtaatgatgcacctgtttctgttcttcaggaagatattgttggaagtcttaaatctacaccagaaaaccatcctgagacacctaaaaaaaagtctgatcctgagctttcaaagagtgaaatgaaacaaagtgaaagtagattagcagaatctaaaccaaatgaaaaccgattggtggagacaaaatcaagtgaaaataagttagaaactaaagttgagacccaaacagaagaacttaaacagaatgagagcagaacaactgaatgcaaacaaaacgagagcaccatagttgagcctaaacaaaatgaaaatagactgtctgacacaaaaccaaatgacaacaaacaaaataatggcagatcagaaacaacaaaatcaaggcctgaaaccccaaagcaaaagggtgaaagccggcctgagactccaaaacaaaagagtgatgggcatcctgaaaccccaaaacagaagggtgatggaaggcctgaaactccaaagcaaaaaggtgagagccgccctgaaactccaaagcaaaaaaatgaagggcgacctgaaacaccaaaacacaggcatgacaataggagggattctggaaagccatctacagagaaaaaacctgaagtgtctaaacataaacaagatactaaatctgactcacctcggttaaaatcagaacgagctgaagccttaaagcagagacctgatgggcgatctgtttctgagtcactaagacgtgaccatgataataaacaaaaatcagatgacaggggtgaatcagagcgacatcgaggggatcagtctagggttcgaagaccagaaacattgagatcctctagtagaaatgaacatggcattaaatctgatagttcaaaaactgataaactagaacgaaaacacaggcatgaatcaggggactcaagggaaagaccatcttctggggaacaaaaatcaagacctgacagtcctcgtgttaaacaaggagattctaataaatcaagatctgataaacttggttttaaatcaccaactagtaaagatgacaaaaggacagagggtaacaagagtaaagtagacactaataaagcacaccctgacaataaggcagaatttccaagttatttgttggggggcaggtctggtgcgttgaaaaattttgtcattccgaaaatcaagagggataaagatggcaatgttactcaggagacaaagaaaatggaaatgaaaggagagccgaaagacaaagtagaaaaaataggattagttgaagatctaaataaaggagctaagcctgtagttgtgctacaaaaactgtctttggatgatgttcagaaacttattaaagatagagaggacaaatcaagaagttcccttaaacctatcaagaataaaccatcaaagtcaaataaaggtagtatagatcaatcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatcctctaggaaacgacataaaaaagatgatgataaagcttgggaatatgaagagcgtgacagaagaagctctggggatcataggagaagtggccactctcatgaaggaagaaggagttcaggtggtggtcgttatcgaaaccgaagtccgtcagattctgacatggaagattattctcctcctcccagccttagtgaggttgctaggaaaatgaagaaaaaagaaaaacagaagaaaaggaaagcatatgaaccaaaactaacacctgaagaaatgatggactcttcaacttttaagagattcacagcctcaatagagaatattttggataatttggaagatatggattttactgcgtttggtgatgatgatgaaattcctcaggaactgctcttaggaaaacatcagcttaatgaacttggcagtgaatctgctaaaataaaagcaatgggtataatggataagctttcaactgacaaaactgtgaaagtcttaaatatcttggagaagaatattcaggatgggtcaaagctttccactttgttaaatcataataacgatactgaagaagaagaaaggttatggagagaccttattatggagagagttacaaaatcagcggatgcttgtcttacaactatcaacattatgacatcccctaacatgccaaaagctgtgtacattgaggatgtaattgaaagagttatacagtacactaaatttcatttgcagaatacactttatcctcagtatgatcctgtttacagattagatcctcatggaggaggcttattaagttcaaaagcaaaacgggctaaatgttctacccataagcagagagtaatagtaatgctttataacaaagtttgtgacattgttagcagcttatcagaattgctagagatacaacttcttacagacacaacaattcttcaggtttcatctatgggaataacaccattttttgtggaaaatgtcagtgaactacagttgtgtgccattaagttagtcactgcagtattctcaagatatgaaaaacataggcagttaattttggaagaaatttttacttcacttgcaagattaccaaccagcaagaggagtttaaggaacttcaggttaaacagtagtgatatggatggagaacctatgtatattcagatggttacagcactggttttacaacttattcagtgtgtggtacacttaccatcatcagagaaggactctaatgcagaagaagattcaaataaaaaaattgaccaggatgttgtcattactaactcttatgaaacagctatgcgaacagcccaaaacttcctctccatcttccttaaaaaatgtggtagtaagcaaggtgaagaagattacagaccactgtttgaaaattttgttcaagaccttctttcaacagtcaataagcctgaatggccagctgctgaactactccttagtttgttagggagactgttggttcatcagttcagtaacaagtcaacagagatggctttaagagtggcatctcttgattaccttggaactgttgctgcacggctaagaaaagatgctgttacaagcaaaatggatcaaggatctatagaacgcattttaaaacaggtttcaggaggggaagatgaaatccaacaattacaaaaagcattgcttgattacttggatgaaaacactgagactgatccttcactagtgttttctcgtaaattctatatagcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagatgaactctgatactgtggactatgatgatgcttgcttgattgttcgatacttggcctccatgaggccgtttgcccagagctttgatatttatttgacacagatcctacgagttcttggtgaaaatgcaattgctgttcgaacaaaagccatgaagtgtttgtctgaggttgttgctgtagaccccagtattctagcaaggcttgatatgcaacgaggtgttcatggacgattgatggataattcgactagtgtccgagaagcagcagtagaattactaggtcgatttgtcctttgtcgacctcagcttgctgaacagtattatgatatgctgattgaaagaatattggatactggtatcagtgtcaggaaaagagtaataaagattctcagagacatttgtattgaacaaccaacatttccaaaaatcacagaaatgtgtgtaaaaatgattcgcagagtcaatgatgaagagggcattaagaaattagtaaatgaaacattccagaaactctggtttactccaactccacacaatgacaaagaagcaatgacaaggaaaattttaaacattaccgatgtggttgcagcatgcagagatactggatatgactggtttgagcaactgcttcaaaacttgttgaagtccgaagaggattcctcatataaacctgtgaagaaagcttgtactcaacttgttgataacctagttgagcacattcttaaatatgaggaatctctagctgactctgacaataaaggtgtgaattctggaagattggtagcttgcataaccactttgttcttattcagcaaaataagaccccagctcatggttaaacatgcaatgactatgcaaccataccttaccactaaatgtagtacgcaaaatgatttcatggttatctgcaatgttgcaaaaatcctagagctagttgtaccactgatggagcatccaagtgaaacttttcttgccactattgaggaagatctaatgaagctcatcatcaaatatggcatgactgtagtgcaacattgtgtgagctgtcttggagctgttgtaaataaagtgacacaaaattttaaatttgtgtgggcttgtttcaatagatactatggtgccatttcaaaattaaaaagtcaacaccaagaggacccaaataacacttcacttctaacaaacaaaccagcacttcttagatcccttttcaccgttggagcactatgtcggcattttgattttgatctggaagattttaaaggcaacagcaaggttaacataaaagataaagtacttgaactattgatgtattttacaaaacactcagatgaagaagtacaaacaaaagctatcattggtctaggatttgcctttattcagcatccaagtctaatgttcgagcaagaagtgaagaatctatataataatattttatctgataagaactcctcagtcaatttaaaaatacaagtgttaaaaaacctccagacctacctacaagaagaagatacacgtatgcagcaggcagatagagactggaagaaagttgcaaaacaggaagacttaaaagaaatgggtgatgtttcctcagggatgagtagttccatcatgcagctttatctcaaacaggtgcttgaggcattttttcacacccagtcaagtgtacgccactttgccctaaatgtcattgcattgactctaaatcaaggtcttattcatccagttcagtgtgtgccatatttaattgctatgggcacagacccagaacctgctatgcggaacaaggctgatcagcaacttgtggaaatagacaaaaaatatgctggattcattcatatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcaaaaacagacgtgactatgctcttgtatatagcagacaatctagcctgttttccataccagacacaggaagagccgttgtttataatgcatcatatagacattacactctcagtttctggtagtaacctactgcagtcattcaaggagtctatggtaaaggacaaaaggaaagagagaaaatcatcacctagtaaggaaaatgagtcaagcgacagtgaagaagaagtttccaggcctcggaagtcacggaaacgtgtagattcagattcagattcagattcagaagacgatataaattcagtgatgaaatgtttgccagaaaattcagctcctttaatcgaatttgcaaatgtgtcccagggtattttattacttctcatgttaaaacaacatttgaagaatctttgtggattttctgatagtaaaattcagaagtactctccatctgaatctgcaaaagtatatgataaagcgataaaccgaaaaacaggagttcattttcatccaaaacaaacactggacttcctgcggagtgacatggctaattccaaaatcacagaagaggtgaaaaggagtatagtaaaacagtatctagatttcaaacttctcatggaacatctggaccctgatgaagaagaagaagaaggggaggtttcagctagcacaaatgctcggaacaaagcaattacctcactgcttggaggaggcagccctaaaaataatacagcagcagagacagaagatgatgaaagtgatggggaggatagaggaggaggcacttcaggggtgaggcggaggaggagtcaacgtatttcgcagcgtattacgtaaaatgatttttatgtgcttatatatgtcagtctattaaatgtacaccaagtaatgtaatacttaaaagagaaaacattttgtagatagagattctctacttacccgtttatacatccttttgtagaaagtttaacataaaagacaataaaaaaacagaaatgagatttatccagcataaagggttaatttttctttgaattgtattaatgtgtgttatttttattgttgctaagttttatgtagctatatggttcatatgtatatataattttatatatcaataagagtaaagacacgggtacaaattaagagttatatggttttacaagtatatgttaaccccttggcgctggcggtcacggtgcgtctcattgccggcaatggaagtgtgccgggaaatcccaactcccggcgtcaagggattaaaagcaataaaaacaataatttcactaaaattcttttgtgtaacacttggtcttttttcccccctcccaatgttttagtcattgagaaggtcaaaacgaaattcagactctacggagttggcagcacagatgaatgaaagtgttgacgtcatggatgtcatcgctatttgctgtccaaagtacaaagatcgaccacaaattgcaagagtagtgcagaaaaccagcagtggcttcagtgttcagtggatggcaggctcctacagtggctcctggactgaggctaagcgccgtgatggccgcaaactggtgccttgggtagacactattaaagagtcagacattatttacaaaaaaattgctctaacgagtgctaataagctgactaataaagttgttcagactttacgatccctgtatgccgccaaggatgggacttccagctaatgaatttgtacatgcagccaaatttacaggaatttttttaaaaggcagaaaaacttgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttttaaaaaata

SEQ ID NO: 455151 - DNA, 6754 bp, Homo sapiens
agacgcagcaagctaccaccagaaacaaagtcaatacaaatacactcaggcgctgaacaatctcagtagtgggtggtgtagaaatagaacttggtgaattctgcttcacaatgaaaggagagccgaaagacaaagtagaaaaaataggattagttgaagatctaaataaaggagctaagcctgtagttgtgctacaaaaactgtctttggatgatgttcagaaacttattaaagatagagaggacaaatcaagaagttcccttaaacctatcaagaataaaccatcaaagtcaaataaaggtagtatagatcaatcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatcctctaggaaacgacataaaaaagatgatgataaagcttgggaatatgaagagcgtgacagaagaagctctggggatcataggagaagtggccactctcatgaaggaagaaggagttcaggtggtggtcgttatcgaaaccgaagtccgtcagattctgacatggaagattattctcctcctcccagccttagtgaggttgctaggaaaatgaagaaaaaagaaaaacagaagaaaaggaaagcatatgaaccaaaactaacacctgaagaaatgatggactcttcaacttttaagagattcacagcctcaatagagaatattttggataatttggaagatatggattttactgcgtttggtgatgatgatgaaattcctcaggaactgctcttaggaaaacatcagcttaatgaacttggcagtgaatctgctaaaataaaagcaatgggtataatggataagctttcaactgacaaaactgtgaaagtcttaaatatcttggagaagaatattcaggatgggtcaaagctttccactttgttaaatcataataacgatactgaagaagaagaaaggttatggagagaccttattatggagagagttacaaaatcagcggatgcttgtcttacaactatcaacattatgacatcccctaacatgccaaaagctgtgtacattgaggatgtaattgaaagagttatacagtacactaaatttcatttgcagaatacactttatcctcagtatgatcctgtttacagattagatcctcatggaggaggcttattaagttcaaaagcaaaacgggctaaatgttctacccataagcagagagtaatagtaatgctttataacaaagtttgtgacattgttagcagcttatcagaattgctagagatacaacttcttacagacacaacaattcttcaggtttcatctatgggaataacaccattttttgtggaaaatgtcagtgaactacagttgtgtgccattaagttagtcactgcagtattctcaagatatgaaaaacataggcagttaattttggaagaaatttttacttcacttgcaagattaccaaccagcaagaggagtttaaggaacttcaggttaaacagtagtgatatggatggagaacctatgtatattcagatggttacagcactggttttacaacttattcagtgtgtggtacacttaccatcatcagagaaggactctaatgcagaagaagattcaaataaaaaaattgaccaggatgttgtcattactaactcttatgaaacagctatgcgaacagcccaaaacttcctctccatcttccttaaaaaatgtggtagtaagcaaggtgaagaagattacagaccactgtttgaaaattttgttcaagaccttctttcaacagtcaataagcctgaatggccagctgctgaactactccttagtttgttagggagactgttggttcatcagttcagtaacaagtcaacagagatggctttaagagtggcatctcttgattaccttggaactgttgctgcacggctaagaaaagatgctgttacaagcaaaatggatcaaggatctatagaacgcattttaaaacaggtttcaggaggggaagatgaaatccaacaattacaaaaagcattgcttgattacttggatgaaaacactgagactgatccttcactagtgttttctcgtaaattctatatagcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagatgaactctgatactgtggactatgatgatgcttgcttgattgttcgatacttggcctccatgaggccgtttgcccagagctttgatatttatttgacacagatcctacgagttcttggtgaaaatgcaattgctgttcgaacaaaagccatgaagtgtttgtctgaggttgttgctgtagaccccagtattctagcaaggcttgatatgcaacgaggtgttcatggacgattgatggataattcgactagtgtccgagaagcagcagtagaattactaggtcgatttgtcctttgtcgacctcagcttgctgaacagtattatgatatgctgattgaaagaatattggatactggtatcagtgtcaggaaaagagtaataaagattctcagagacatttgtattgaacaaccaacatttccaaaaatcacagaaatgtgtgtaaaaatgattcgcagagtcaatgatgaagagggcattaagaaattagtaaatgaaacattccagaaactctggtttactccaactccacacaatgacaaagaagcaatgacaaggaaaattttaaacattaccgatgtggttgcagcatgcagagatactggatatgactggtttgagcaactgcttcaaaacttgttgaagtccgaagaggattcctcatataaacctgtgaagaaagcttgtactcaacttgttgataacctagttgagcacattcttaaatatgaggaatctctagctgactctgacaataaaggtgtgaattctggaagattggtagcttgcataaccactttgttcttattcagcaaaataagaccccagctcatggttaaacatgcaatgactatgcaaccataccttaccactaaatgtagtacgcaaaatgatttcatggttatctgcaatgttgcaaaaatcctagagctagttgtaccactgatggagcatccaagtgaaacttttcttgccactattgaggaagatctaatgaagctcatcatcaaatatggcatgactgtagtgcaacattgtgtgagctgtcttggagctgttgtaaataaagtgacacaaaattttaaatttgtgtgggcttgtttcaatagatactatggtgccatttcaaaattaaaaagtcaacaccaagaggacccaaataacacttcacttctaacaaacaaaccagcacttcttagatcccttttcaccgttggagcactatgtcggcattttgattttgatctggaagattttaaaggcaacagcaaggttaacataaaagataaagtacttgaactattgatgtattttacaaaacactcagatgaagaagtacaaacaaaagctatcattggtctaggatttgcctttattcagcatccaagtctaatgttcgagcaagaagtgaagaatctatataataatattttatctgataagaactcctcagtcaatttaaaaatacaagtgttaaaaaacctccagacctacctacaagaagaagatacacgtatgcagcaggcagatagagactggaagaaagttgcaaaacaggaagacttaaaagaaatgggtgatgtttcctcagggatgagtagttccatcatgcagctttatctcaaacaggtgcttgaggcattttttcacacccagtcaagtgtacgccactttgccctaaatgtcattgcattgactctaaatcaaggtcttattcatccagttcagtgtgtgccatatttaattgctatgggcacagacccagaacctgctatgcggaacaaggctgatcagcaacttgtggaaatagacaaaaaatatgctggattcattcatatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcaaaaacagacgtgactatgctcttgtatatagcagacaatctagcctgttttccataccagacacaggaagagccgttgtttataatgcatcatatagacattacactctcagtttctggtagtaacctactgcagtcattcaaggagtctatggtaaaggacaaaaggaaagagagaaaatcatcacctagtaaggaaaatgagtcaagcgacagtgaagaagaagtttccaggcctcggaagtcacggaaacgtgtagattcagattcagattcagattcagaagacgatataaattcagtgatgaaatgtttgccagaaaattcagctcctttaatcgaatttgcaaatgtgtcccagggtattttattacttctcatgttaaaacaacatttgaagaatctttgtggattttctgatagtaaaattcagaagtactctccatctgaatctgcaaaagtatatgataaagcgataaaccgaaaaacaggagttcattttcatccaaaacaaacactggacttcctgcggagtgacatggctaattccaaaatcacagaagaggtgaaaaggagtatagtaaaacagtatctagatttcaaacttctcatggaacatctggaccctgatgaagaagaagaagaaggggaggtttcagctagcacaaatgctcggaacaaagcaattacctcactgcttggaggaggcagccctaaaaataatacagcagcagagacagaagatgatgaaagtgatggggaggatagaggaggaggcacttcaggggtgaggcggaggaggagtcaacgtatttcgcagcgtattacgtaaaatgatttttatgtgcttatatatgtcagtctattaaatgtacaccaagtaatgtaatacttaaaagagaaaacattttgtagatagagattctctacttacccgtttatacatccttttgtagaaagtttaacataaaagacaataaaaaaacagaaatgagatttatccagcataaagggttaatttttctttgaattgtattaatgtgtgttatttttattgttgctaagttttatgtagctatatggttcatatgtatatataattttatatatcaataagagtaaagacacgggtacaaattaagagttatatggttttacaagtatatgttaaccccttggcgctggcggtcacggtgcgtctcattgccggcaatggaagtgtgccgggaaatcccaactcccggcgtcaagggattaaaagcaataaaaacaataatttcactaaaattcttttgtgtaacacttggtcttttttcccccctcccaatgttttagtcattgagaaggtcaaaacgaaattcagactctacggagttggcagcacagatgaatgaaagtgttgacgtcatggatgtcatcgctatttgctgtccaaagtacaaagatcgaccacaaattgcaagagtagtgcagaaaaccagcagtggcttcagtgttcagtggatggcaggctcctacagtggctcctggactgaggctaagcgccgtgatggccgcaaactggtgccttgggtagacactattaaagagtcagacattatttacaaaaaaattgctctaacgagtgctaataagctgactaataaagttgttcagactttacgatccctgtatgccgccaaggatgggacttccagctaatgaatttgtacatgcagccaaatttacaggaatttttttaaaaggcagaaaaacttgaaataccaacattctggcaaaaaaaaatcagttttatgaagagtaagtggaacctgggatgcaggaacaaaagaaggaaatgttgggcaaacatttttgtgggagctcccttcgctgttgtgcagcagaaacagattctcagttcatttttactcccactgtattatagtttaacaaaaattgtttatatcttggaaaaaaaactttctgtttaaaaaaaataaacaagtgaatgttggaaattagtctgttaatgttcttaataaagtgttcttggagtttaacctagcagcggatggctttctttagcttagcccagtttccagggaagcattgttttttccaggctgtaaaatggcagaatctcctggatatataatttattctgttgaaaaaaaaaaaagcatgcagtatctatgacctatctgcagaaggagtttttgtaaatgtagattttgatgtattaggtcaccctgaaaacaatacaagaaaagggatccccaggtaatctggtggagcgaatactgcaataaatttttttacttctctttgtta

SEQ ID NO: 455152 - DNA, 8738 bp, Homo sapiens
cagcatcggtatcaagtcccattgttgcaggtggtttgagaaacatacatgataataaagtttctggtccgttgtctggcaattcagctaatcatcatgctgataatcctagacatggttcaagtgaggactacctacacatggtgcacaggctaagtagtgacgatggagattcttcaacaatgaggaatgctgcatcttttcccttgagatctccacagccagtatgctcccctgctggaagtgaaggaactcctaaaggctcaagaccacctttaatcctacaatctcagtctctaccttgttcatcacctcgagatgttccaccagatatcttgctagattctccagaaagaaaacaaaagaagcagaagaaaatgaaattaggcaaggatgaaaaagagcagagtgagaaagcggcaatgtatgatataattagttctccatccaaggactctactaaacttacattaagactttctcgtgtaaggtcttcagacatggaccagcaagaggatatgatttctggtgtggaaaatagcaatgtttcagaaaatgatattccttttaatgtgcagtacccaggacagacttcaaaaacacccattactccacaagatataaaccgcccactaaatgctgctcaatgtttgtcgcagcaagaacaaacagcattccttccagcaaatcaagtgcctgttttacaacagaacacttcagttgctgcaaaacaaccccagacttctgtggtacagaatcaacaacagatatcacaacagggacctatatatgatgaagtggaattggatgcattggctgaaattgagcgaatagagagagaatcagctattgaaagggagcgcttctcaaaagaagttcaagataaagataagcctttgaaaaaaagaaaacaagattcttacccacaggaggctgggggtgctacaggaggtaatagaccagcttctcaggagacgggttctacgggaaatgggtcaaggccagcattaatggttagcattgatcttcatcaggcaggaagagtggactctcaggcttctataactcaggattcagactccataaaaaagcctgaagaaatcaaacaatgtaatgatgcacctgtttctgttcttcaggaagatattgttggaagtcttaaatctacaccagaaaaccatcctgagacacctaaaaaaaagtctgatcctgagctttcaaagagtgaaatgaaacaaagtgaaagtagattagcagaatctaaaccaaatgaaaaccgattggtggagacaaaatcaagtgaaaataagttagaaactaaagttgagacccaaacagaagaacttaaacagaatgagagcagaacaactgaatgcaaacaaaacgagagcaccatagttgagcctaaacaaaatgaaaatagactgtctgacacaaaaccaaatgacaacaaacaaaataatggcagatcagaaacaacaaaatcaaggcctgaaaccccaaagcaaaagggtgaaagccggcctgagactccaaaacaaaagagtgatgggcatcctgaaaccccaaaacagaagggtgatggaaggcctgaaactccaaagcaaaaaggtgagagccgccctgaaactccaaagcaaaaaaatgaagggcgacctgaaacaccaaaacacaggcatgacaataggagggattctggaaagccatctacagagaaaaaacctgaagtgtctaaacataaacaagatactaaatctgactcacctcggttaaaatcagaacgagctgaagccttaaagcagagacctgatgggcgatctgtttctgagtcactaagacgtgaccatgataataaacaaaaatcagatgacaggggtgaatcagagcgacatcgaggggatcagtctagggttcgaagaccagaaacattgagatcctctagtagaaatgaacatggcattaaatctgatagttcaaaaactgataaactagaacgaaaacacaggcatgaatcaggggactcaagggaaagaccatcttctggggaacaaaaatcaagacctgacagtcctcgtgttaaacaaggagattctaataaatcaagatctgataaacttggttttaaatcaccaactagtaaagatgacaaaaggacagagggtaacaagagtaaagtagacactaataaagcacaccctgacaataaggcagaatttccaagttatttgttggggggcaggtctggtgcgttgaaaaattttgtcattccgaaaatcaagagggataaagatggcaatgttactcaggagacaaagaaaatggaaatgaaaggagagccgaaagacaaagtagaaaaaataggattagttgaagatctaaataaaggagctaagcctgtagttgtgctacaaaaactgtctttggatgatgttcagaaacttattaaagatagagaggacaaatcaagaagttcccttaaacctatcaagaataaaccatcaaagtcaaataaaggtagtatagatcaatcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatcctctaggaaacgacataaaaaagatgatgataaagcttgggaatatgaagagcgtgacagaagaagctctggggatcataggagaagtggccactctcatgaaggaagaaggagttcaggtggtggtcgttatcgaaaccgaagtccgtcagattctgacatggaagattattctcctcctcccagccttagtgaggttgctaggaaaatgaagaaaaaagaaaaacagaagaaaaggaaagcatatgaaccaaaactaacacctgaagaaatgatggactcttcaacttttaagagattcacagcctcaatagagaatattttggataatttggaagatatggattttactgcgtttggtgatgatgatgaaattcctcaggaactgctcttaggaaaacatcagcttaatgaacttggcagtgaatctgctaaaataaaagcaatgggtataatggataagctttcaactgacaaaactgtgaaagtcttaaatatcttggagaagaatattcaggatgggtcaaagctttccactttgttaaatcataataacgatactgaagaagaagaaaggttatggagagaccttattatggagagagttacaaaatcagcggatgcttgtcttacaactatcaacattatgacatcccctaacatgccaaaagctgtgtacattgaggatgtaattgaaagagttatacagtacactaaatttcatttgcagaatacactttatcctcagtatgatcctgtttacagattagatcctcatggaggaggcttattaagttcaaaagcaaaacgggctaaatgttctacccataagcagagagtaatagtaatgctttataacaaagtttgtgacattgttagcagcttatcagaattgctagagatacaacttcttacagacacaacaattcttcaggtttcatctatgggaataacaccattttttgtggaaaatgtcagtgaactacagttgtgtgccattaagttagtcactgcagtattctcaagatatgaaaaacataggcagttaattttggaagaaatttttacttcacttgcaagattaccaaccagcaagaggagtttaaggaacttcaggttaaacagtagtgatatggatggagaacctatgtatattcagatggttacagcactggttttacaacttattcagtgtgtggtacacttaccatcatcagagaaggactctaatgcagaagaagattcaaataaaaaaattgaccaggatgttgtcattactaactcttatgaaacagctatgcgaacagcccaaaacttcctctccatcttccttaaaaaatgtggtagtaagcaaggtgaagaagattacagaccactgtttgaaaattttgttcaagaccttctttcaacagtcaataagcctgaatggccagctgctgaactactccttagtttgttagggagactgttggttcatcagttcagtaacaagtcaacagagatggctttaagagtggcatctcttgattaccttggaactgttgctgcacggctaagaaaagatgctgttacaagcaaaatggatcaaggatctatagaacgcattttaaaacaggtttcaggaggggaagatgaaatccaacaattacaaaaagcattgcttgattacttggatgaaaacactgagactgatccttcactagtgttttctcgtaaattctatatagcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagatgaactctgatactgtggactatgatgatgcttgcttgattgttcgatacttggcctccatgaggccgtttgcccagagctttgatatttatttgacacagatcctacgagttcttggtgaaaatgcaattgctgttcgaacaaaagccatgaagtgtttgtctgaggttgttgctgtagaccccagtattctagcaaggcttgatatgcaacgaggtgttcatggacgattgatggataattcgactagtgtccgagaagcagcagtagaattactaggtcgatttgtcctttgtcgacctcagcttgctgaacagtattatgatatgctgattgaaagaatattggatactggtatcagtgtcaggaaaagagtaataaagattctcagagacatttgtattgaacaaccaacatttccaaaaatcacagaaatgtgtgtaaaaatgattcgcagagtcaatgatgaagagggcattaagaaattagtaaatgaaacattccagaaactctggtttactccaactccacacaatgacaaagaagcaatgacaaggaaaattttaaacattaccgatgtggttgcagcatgcagagatactggatatgactggtttgagcaactgcttcaaaacttgttgaagtccgaagaggattcctcatataaacctgtgaagaaagcttgtactcaacttgttgataacctagttgagcacattcttaaatatgaggaatctctagctgactctgacaataaaggtgtgaattctggaagattggtagcttgcataaccactttgttcttattcagcaaaataagaccccagctcatggttaaacatgcaatgactatgcaaccataccttaccactaaatgtagtacgcaaaatgatttcatggttatctgcaatgttgcaaaaatcctagagctagttgtaccactgatggagcatccaagtgaaacttttcttgccactattgaggaagatctaatgaagctcatcatcaaatatggcatgactgtagtgcaacattgtgtgagctgtcttggagctgttgtaaataaagtgacacaaaattttaaatttgtgtgggcttgtttcaatagatactatggtgccatttcaaaattaaaaagtcaacaccaagaggacccaaataacacttcacttctaacaaacaaaccagcacttcttagatcccttttcaccgttggagcactatgtcggcattttgattttgatctggaagattttaaaggcaacagcaaggttaacataaaagataaagtacttgaactattgatgtattttacaaaacactcagatgaagaagtacaaacaaaagctatcattggtctaggatttgcctttattcagcatccaagtctaatgttcgagcaagaagtgaagaatctatataataatattttatctgataagaactcctcagtcaatttaaaaatacaagtgttaaaaaacctccagacctacctacaagaagaagatacacgtatgcagcaggcagatagagactggaagaaagttgcaaaacaggaagacttaaaagaaatgggtgatgtttcctcagggatgagtagttccatcatgcagctttatctcaaacaggtgcttgaggcattttttcacacccagtcaagtgtacgccactttgccctaaatgtcattgcattgactctaaatcaaggtcttattcatccagttcagtgtgtgccatatttaattgctatgggcacagacccagaacctgctatgcggaacaaggctgatcagcaacttgtggaaatagacaaaaaatatgctggattcattcatatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcaaaaacagacgtgactatgctcttgtatatagcagacaatctagcctgttttccataccagacacaggaagagccgttgtttataatgcatcatatagacattacactctcagtttctggtagtaacctactgcagtcattcaaggagtctatggtaaaggacaaaaggaaagagagaaaatcatcacctagtaaggaaaatgagtcaagcgacagtgaagaagaagtttccaggcctcggaagtcacggaaacgtgtagattcagattcagattcagattcagaagacgatataaattcagtgatgaaatgtttgccagaaaattcagctcctttaatcgaatttgcaaatgtgtcccagggtattttattacttctcatgttaaaacaacatttgaagaatctttgtggattttctgatagtaaaattcagaagtactctccatctgaatctgcaaaagtatatgataaagcgataaaccgaaaaacaggagttcattttcatccaaaacaaacactggacttcctgcggagtgacatggctaattccaaaatcacagaagaggtgaaaaggagtatagtaaaacagtatctagatttcaaacttctcatggaacatctggaccctgatgaagaagaagaagaaggggaggtttcagctagcacaaatgctcggaacaaagcaattacctcactgcttggaggaggcagccctaaaaataatacagcagcagagacagaagatgatgaaagtgatggggaggatagaggaggaggcacttcagggtcattgagaaggtcaaaacgaaattcagactctacggagttggcagcacagatgaatgaaagtgttgacgtcatggatgtcatcgctatttgctgtccaaagtacaaagatcgaccacaaattgcaagagtagtgcagaaaaccagcagtggcttcagtgttcagtggatggcaggctcctacagtggctcctggactgaggctaagcgccgtgatggccgcaaactggtgccttgggtagacactattaaagagtcagacattatttacaaaaaaattgctctaacgagtgctaataagctgactaataaagttgttcagactttacgatccctgtatgccgccaaggatgggacttccagctaatgaatttgtacatgcagccaaatttacaggaatttttttaaaaggcagaaaaacttgaaataccaacattctggcaaaaaaaaatcagttttatgaagagtaagtggaacctgggatgcaggaacaaaagaaggaaatgttgggcaaacatttttgtgggagctcccttcgctgttgtgcagcagaaacagattctcagttcatttttactcccactgtattatagtttaacaaaaattgtttatatcttggaaaaaaaactttctgtttaaaaaaaataaacaagtgaatgttggaaattagtctgttaatgttcttaataaagtgttcttggagtttaacctagcagcggatggctttctttagcttagcccagtttccagggaagcattgttttttccaggctgtaaaatggcagaatctcctggatatataatttattctgttgaaaaaaaaaaaagcatgcagtatctatgacctatctgcagaaggagtttttgtaaatgtagattttgatgtattaggtcaccctgaaaacaatacaagaaaagggatccccaggtaatctggtggagcgaatactgcaataaatttttttacttctctttgttacttgtctgtttccatttgaatttcttattgtaaaaatctgtttaaatccatttatattattttacagtcttttatgtaaaatttattatatcactggttttcaaagcaaaacataaaatattgtttatacagtttgtataggctgacttctgaataattggtatctattattttcattcccataagagggtgtaaacaattaactccagggttttattgtatcctgcaatatttagtattaactatatatgatttagcactgtgccaaacacattttcaagagtacattttgatataaaaagaaactattgtttattc

SEQ ID NO: 455153 - DNA, 8461 bp, Homo sapiens
cagcatcggtatcaagtcccattgttgcaggtggtttgagaaacatacatgataataaagtttctggtccgttgtctggcaattcagctaatcatcatgctgataatcctagacatggttcaagtgaggactacctacacatggtgcacaggctaagtagtgacgatggagattcttcaacaatgaggaatgctgcatcttttcccttgagatctccacagccagtatgctcccctgctggaagtgaaggaactcctaaaggctcaagaccacctttaatcctacaatctcagtctctaccttgttcatcacctcgagatgttccaccagatatcttgctagattctccagaaagaaaacaaaagaagcagaagaaaatgaaattaggcaaggatgaaaaagagcagagtgagaaagcggcaatgtatgatataattagttctccatccaaggactctactaaacttacattaagactttctcgtgtaaggtcttcagacatggaccagcaagaggatatgatttctggtgtggaaaatagcaatgtttcagaaaatgatattccttttaatgtgcagtacccaggacagacttcaaaaacacccattactccacaagatataaaccgcccactaaatgctgctcaatgtttgtcgcagcaagaacaaacagcattccttccagcaaatcaagtgcctgttttacaacagaacacttcagttgctgcaaaacaaccccagacttctgtggtacagaatcaacaacagatatcacaacagggacctatatatgatgaagtggaattggatgcattggctgaaattgagcgaatagagagagaatcagctattgaaagggagcgcttctcaaaagaagttcaagataaagataagcctttgaaaaaaagaaaacaagattcttacccacaggaggctgggggtgctacaggaggtaatagaccagcttctcaggagacgggttctacgggaaatgggtcaaggccagcattaatggttagcattgatcttcatcaggcaggaagagtggactctcaggcttctataactcaggattcagactccataaaaaagcctgaagaaatcaaacaatgtaatgatgcacctgtttctgttcttcaggaagatattgttggaagtcttaaatctacaccagaaaaccatcctgagacacctaaaaaaaagtctgatcctgagctttcaaagagtgaaatgaaacaaagtgaaagtagattagcagaatctaaaccaaatgaaaaccgattggtggagacaaaatcaagtgaaaataagttagaaactaaagttgagacccaaacagaagaacttaaacagaatgagagcagaacaactgaatgcaaacaaaacgagagcaccatagttgagcctaaacaaaatgaaaatagactgtctgacacaaaaccaaatgacaacaaacaaaataatggcagatcagaaacaacaaaatcaaggcctgaaaccccaaagcaaaagggtgaaagccggcctgagactccaaaacaaaagagtgatgggcatcctgaaaccccaaaacagaagggtgatggaaggcctgaaactccaaagcaaaaaggtgagagccgccctgaaactccaaagcaaaaaaatgaagggcgacctgaaacaccaaaacacaggcatgacaataggagggattctggaaagccatctacagagaaaaaacctgaagtgtctaaacataaacaagatactaaatctgactcacctcggttaaaatcagaacgagctgaagccttaaagcagagacctgatgggcgatctgtttctgagtcactaagacgtgaccatgataataaacaaaaatcagatgacaggggtgaatcagagcgacatcgaggggatcagtctagggttcgaagaccagaaacattgagatcctctagtagaaatgaacatggcattaaatctgatagttcaaaaactgataaactagaacgaaaacacaggcatgaatcaggggactcaagggaaagaccatcttctggggaacaaaaatcaagacctgacagtcctcgtgttaaacaaggagattctaataaatcaagatctgataaacttggttttaaatcaccaactagtaaagatgacaaaaggacagagggtaacaagagtaaagtagacactaataaagcacaccctgacaataaggcagaatttccaagttatttgttggggggcaggtctggtgcgttgaaaaattttgtcattccgaaaatcaagagggataaagatggcaatgttactcaggagacaaagaaaatggaaatgaaaggagagccgaaagacaaagtagaaaaaataggattagttgaagatctaaataaaggagctaagcctgtagttgtgctacaaaaactgtctttggatgatgttcagaaacttattaaagatagagaggacaaatcaagaagttcccttaaacctatcaagaataaaccatcaaagtcaaataaaggtagtatagatcaatcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatcctctaggaaacgacataaaaaagatgatgataaagcttgggaatatgaagagcgtgacagaagaagctctggggatcataggagaagtggccactctcatgaaggaagaaggagttcaggtggtggtcgttatcgaaaccgaagtccgtcagattctgacatggaagattattctcctcctcccagccttagtgaggttgctaggaaaatgaagaaaaaagaaaaacagaagaaaaggaaagcatatgaaccaaaactaacacctgaagaaatgatggactcttcaacttttaagagattcacagcctcaatagagaatattttggataatttggaagatatggattttactgcgtttggtgatgatgatgaaattcctcaggaactgctcttaggaaaacatcagcttaatgaacttggcagtgaatctgctaaaataaaagcaatgggtataatggataagctttcaactgacaaaactgtgaaagtcttaaatatcttggagaagaatattcaggatgggtcaaagctttccactttgttaaatcataataacgatactgaagaagaagaaaggttatggagagaccttattatggagagagttacaaaatcagcggatgcttgtcttacaactatcaacattatgacatcccctaacatgccaaaagctgtgtacattgaggatgtaattgaaagagttatacagtacactaaatttcatttgcagaatacactttatcctcagtatgatcctgtttacagattagatcctcatggaggaggcttattaagttcaaaagcaaaacgggctaaatgttctacccataagcagagagtaatagtaatgctttataacaaagtttgtgacattgttagcagcttatcagaattgctagagatacaacttcttacagacacaacaattcttcaggtttcatctatgggaataacaccattttttgtggaaaatgtcagtgaactacagttgtgtgccattaagttagtcactgcagtattctcaagatatgaaaaacataggcagttaattttggaagaaatttttacttcacttgcaagattaccaaccagcaagaggagtttaaggaacttcaggttaaacagtagtgatatggatggagaacctatgtatattcagatggttacagcactggttttacaacttattcagtgtgtggtacacttaccatcatcagagaaggactctaatgcagaagaagattcaaataaaaaaattgaccaggatgttgtcattactaactcttatgaaacagctatgcgaacagcccaaaacttcctctccatcttccttaaaaaatgtggtagtaagcaaggtgaagaagattacagaccactgtttgaaaattttgttcaagaccttctttcaacagtcaataagcctgaatggccagctgctgaactactccttagtttgttagggagactgttggttcatcagttcagtaacaagtcaacagagatggctttaagagtggcatctcttgattaccttggaactgttgctgcacggctaagaaaagatgctgttacaagcaaaatggatcaaggatctatagaacgcattttaaaacaggtttcaggaggggaagatgaaatccaacaattacaaaaagcattgcttgattacttggatgaaaacactgagactgatccttcactagtgttttctcgtaaattctatatagcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagatgaactctgatactgtggactatgatgatgcttgcttgattgttcgatacttggcctccatgaggccgtttgcccagagctttgatatttatttgacacagatcctacgagttcttggtgaaaatgcaattgctgttcgaacaaaagccatgaagtgtttgtctgaggttgttgctgtagaccccagtattctagcaaggcttgatatgcaacgaggtgttcatggacgattgatggataattcgactagtgtccgagaagcagcagtagaattactaggtcgatttgtcctttgtcgacctcagcttgctgaacagtattatgatatgctgattgaaagaatattggatactggtatcagtgtcaggaaaagagtaataaagattctcagagacatttgtattgaacaaccaacatttccaaaaatcacagaaatgtgtgtaaaaatgattcgcagagtcaatgatgaagagggcattaagaaattagtaaatgaaacattccagaaactctggtttactccaactccacacaatgacaaagaagcaatgacaaggaaaattttaaacattaccgatgtggttgcagcatgcagagatactggatatgactggtttgagcaactgcttcaaaacttgttgaagtccgaagaggattcctcatataaacctgtgaagaaagcttgtactcaacttgttgataacctagttgagcacattcttaaatatgaggaatctctagctgactctgacaataaaggtgtgaattctggaagattggtagcttgcataaccactttgttcttattcagcaaaataagaccccagctcatggttaaacatgcaatgactatgcaaccataccttaccactaaatgtagtacgcaaaatgatttcatggttatctgcaatgttgcaaaaatcctagagctagttgtaccactgatggagcatccaagtgaaacttttcttgccactattgaggaagatctaatgaagctcatcatcaaatatggcatgactgtagtgcaacattgtgtgagctgtcttggagctgttgtaaataaagtgacacaaaattttaaatttgtgtgggcttgtttcaatagatactatggtgccatttcaaaattaaaaagtcaacaccaagaggacccaaataacacttcacttctaacaaacaaaccagcacttcttagatcccttttcaccgttggagcactatgtcggcattttgattttgatctggaagattttaaaggcaacagcaaggttaacataaaagataaagtacttgaactattgatgtattttacaaaacactcagatgaagaagtacaaacaaaagctatcattggtctaggatttgcctttattcagcatccaagtctaatgttcgagcaagaagtgaagaatctatataataatattttatctgataagaactcctcagtcaatttaaaaatacaagtgttaaaaaacctccagacctacctacaagaagaagatacacgtatgcagcaggcagatagagactggaagaaagttgcaaaacaggaagacttaaaagaaatgggtgatgtttcctcagggatgagtagttccatcatgcagctttatctcaaacaggtgcttgaggcattttttcacacccagtcaagtgtacgccactttgccctaaatgtcattgcattgactctaaatcaaggtcttattcatccagttcagtgtgtgccatatttaattgctatgggcacagacccagaacctgctatgcggaacaaggctgatcagcaacttgtggaaatagacaaaaaatatgctggattcattcatatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcaaaaacagacgtgactatgctcttgtatatagcagacaatctagcctgttttccataccagacacaggaagagccgttgtttataatgcatcatatagacattacactctcagtttctggtagtaacctactgcagtcattcaaggagtctatggtaaaggacaaaaggaaagagagaaaatcatcacctagtaaggaaaatgagtcaagcgacagtgaagaagaagtttccaggcctcggaagtcacggaaacgtgtagattcagattcagattcagattcagaagacgatataaattcagtgatgaaatgtttgccagaaaattcagctcctttaatcgaatttgcaaatgtgtcccagggtattttattacttctcatgttaaaacaacatttgaagaatctttgtggattttctgatagtaaaattcagaagtactctccatctgaatctgcaaaagtatatgataaagcgataaaccgaaaaacaggagttcattttcatccaaaacaaacactggacttcctgcggagtgacatggctaattccaaaatcacagaagaggtgaaaaggagtatagtaaaacagtatctagatttcaaacttctcatggaacatctggaccctgatgaagaagaagaagaaggggaggtttcagctagcacaaatgctcggaacaaagcaattacctcactgcttggaggaggcagccctaaaaataatacagcagcagagacagaagatgatgaaagtgatggggaggatagaggaggaggcacttcaggggtgaggcggaggaggagtcaacgtatttcgcagcgtattactcattgagaaggtcaaaacgaaattcagactctacggagttggcagcacagatgaatgaaagtgttgacgtcatggatgtcatcgctatttgctgtccaaagtacaaagatcgaccacaaattgcaagagtagtgcagaaaaccagcagtggcttcagtgttcagtggatggcaggctcctacagtggctcctggactgaggctaagcgccgtgatggccgcaaactggtgccttgggtagacactattaaagagtcagacattatttacaaaaaaattgctctaacgagtgctaataagctgactaataaagttgttcagactttacgatccctgtatgccgccaaggatgggacttccagctaatgaatttgtacatgcagccaaatttacaggaatttttttaaaaggcagaaaaacttgaaataccaacattctggcaaaaaaaaatcagttttatgaagagtaagtggaacctgggatgcaggaacaaaagaaggaaatgttgggcaaacatttttgtgggagctcccttcgctgttgtgcagcagaaacagattctcagttcatttttactcccactgtattatagtttaacaaaaattgtttatatcttggaaaaaaaactttctgtttaaaaaaaataaacaagtgaatgttggaaattagtctgttaatgttcttaataaagtgttcttggagtttaacctagcagcggatggctttctttagcttagcccagtttccagggaagcattgttttttccaggctgtaaaatggcagaatctcctggatatataatttattctgttgaaaaaaaaaaaagcatgcagtatctatgacctatctgcagaaggagtttttgtaaatgtagattttgatgtattaggtcaccctgaaaacaatacaagaaaagggatccccaggtaatctggtggagcgaatactgcaataaatttttttacttctctttgtta

SEQ ID NO: 455154 - DNA, 7219 bp, Homo sapiens
cagcatcggtatcaagtcccattgttgcaggtggtttgagaaacatacatgataataaagtttctggtccgttgtctggcaattcagctaatcatcatgctgataatcctagacatggttcaagtgaggactacctacacatggtgcacaggctaagtagtgacgatggagattcttcaacaatgaggaatgctgcatcttttcccttgagatctccacagccagtatgctcccctgctggaagtgaaggaactcctaaaggctcaagaccacctttaatcctacaatctcagtctctaccttgttcatcacctcgagatgttccaccagatatcttgctagattctccagaaagaaaacaaaagaagcagaagaaaatgaaattaggcaaggatgaaaaagagcagagtgagaaagcggcaatgtatgatataattagttctccatccaaggactctactaaacttacattaagactttctcgtgtaaggtcttcagacatggaccagcaagaggatatgatttctggtgtggaaaatagcaatgtttcagaaaatgatattccttttaatgtgcagtacccaggacagacttcaaaaacacccattactccacaagatataaaccgcccactaaatgctgctcaatgtttgtcgcagcaagaacaaacagcattccttccagcaaatcaagtgcctgttttacaacagaacacttcagttgctgcaaaacaaccccagacttctgtggtacagaatcaacaacagatatcacaacagggacctatatatgatgaagtggaattggatgcattggctgaaattgagcgaatagagagagaatcagctattgaaagggagcgcttctcaaaagaagttcaagataaagataagcctttgaaaaaaagaaaacaagattcttacccacaggaggctgggggtgctacaggaggtaatagaccagcttctcaggagacgggttctacgggaaatgggtcaaggccagcattaatggttagcattgatcttcatcaggcaggaagagtggactctcaggcttctataactcaggattcagactccataaaaaagcctgaagaaatcaaacaatgtaatgatgcacctgtttctgttcttcaggaagatattgttggaagtcttaaatctacaccagaaaaccatcctgagacacctaaaaaaaagtctgatcctgagctttcaaagagtgaaatgaaacaaagtgaaagtagattagcagaatctaaaccaaatgaaaaccgattggtggagacaaaatcaagtgaaaataagttagaaactaaagttgagacccaaacagaagaacttaaacagaatgagagcagaacaactgaatgcaaacaaaacgagagcaccatagttgagcctaaacaaaatgaaaatagactgtctgacacaaaaccaaatgacaacaaacaaaataatggcagatcagaaacaacaaaatcaaggcctgaaaccccaaagcaaaagggtgaaagccggcctgagactccaaaacaaaagagtgatgggcatcctgaaaccccaaaacagaagggtgatggaaggcctgaaactccaaagcaaaaaggtgagagccgccctgaaactccaaagcaaaaaaatgaagggcgacctgaaacaccaaaacacaggcatgacaataggagggattctggaaagccatctacagagaaaaaacctgaagtgtctaaacataaacaagatactaaatctgactcacctcggttaaaatcagaacgagctgaagccttaaagcagagacctgatgggcgatctgtttctgagtcactaagacgtgaccatgataataaacaaaaatcagatgacaggggtgaatcagagcgacatcgaggggatcagtctagggttcgaagaccagaaacattgagatcctctagtagaaatgaacatggcattaaatctgatagttcaaaaactgataaactagaacgaaaacacaggcatgaatcaggggactcaagggaaagaccatcttctggggaacaaaaatcaagacctgacagtcctcgtgttaaacaaggagattctaataaatcaagatctgataaacttggttttaaatcaccaactagtaaagatgacaaaaggacagagggtaacaagagtaaagtagacactaataaagcacaccctgacaataaggcagaatttccaagttatttgttggggggcaggtctggtgcgttgaaaaattttgtcattccgaaaatcaagagggataaagatggcaatgttactcaggagacaaagaaaatggaaatgaaaggagagccgaaagacaaagtagaaaaaataggattagttgaagatctaaataaaggagctaagcctgtagttgtgctacaaaaactgtctttggatgatgttcagaaacttattaaagatagagaggacaaatcaagaagttcccttaaacctatcaagaataaaccatcaaagtcaaataaaggtagtatagatcaatcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatcctctaggaaacgacataaaaaagatgatgataaagcttgggaatatgaagagcgtgacagaagaagctctggggatcataggagaagtggccactctcatgaaggaagaaggagttcaggtggtggtcgttatcgaaaccgaagtccgtcagattctgacatggaagattattctcctcctcccagccttagtgaggttgctaggaaaatgaagaaaaaagaaaaacagaagaaaaggaaagcatatgaaccaaaactaacacctgaagaaatgatggactcttcaacttttaagagattcacagcctcaatagagaatattttggataatttggaagatatggattttactgcgtttggtgatgatgatgaaattcctcaggaactgctcttaggaaaacatcagcttaatgaacttggcagtgaatctgctaaaataaaagcaatgggtataatggataagctttcaactgacaaaactgtgaaagtcttaaatatcttggagaagaatattcaggatgggtcaaagctttccactttgttaaatcataataacgatactgaagaagaagaaaggttatggagagaccttattatggagagagttacaaaatcagcggatgcttgtcttacaactatcaacattatgacatcccctaacatgccaaaagctgtgtacattgaggatgtaattgaaagagttatacagtacactaaatttcatttgcagaatacactttatcctcagtatgatcctgtttacagattagatcctcatggaggaggcttattaagttcaaaagcaaaacgggctaaatgttctacccataagcagagagtaatagtaatgctttataacaaagtttgtgacattgttagcagcttatcagaattgctagagatacaacttcttacagacacaacaattcttcaggtttcatctatgggaataacaccattttttgtggaaaatgtcagtgaactacagttgtgtgccattaagttagtcactgcagtattctcaagatatgaaaaacataggcagttaattttggaagaaatttttacttcacttgcaagattaccaaccagcaagaggagtttaaggaacttcaggttaaacagtagtgatatggatggagaacctatgtatattcagatggttacagcactggttttacaacttattcagtgtgtggtacacttaccatcatcagagaaggactctaatgcagaagaagattcaaataaaaaaattgaccaggatgttgtcattactaactcttatgaaacagctatgcgaacagcccaaaacttcctctccatcttccttaaaaaatgtggtagtaagcaaggtgaagaagattacagaccactgtttgaaaattttgttcaagaccttctttcaacagtcaataagcctgaatggccagctgctgaactactccttagtttgttagggagactgttggttcatcagttcagtaacaagtcaacagagatggctttaagagtggcatctcttgattaccttggaactgttgctgcacggctaagaaaagatgctgttacaagcaaaatggatcaaggatctatagaacgcattttaaaacaggtttcaggaggggaagatgaaatccaacaattacaaaaagcattgcttgattacttggatgaaaacactgagactgatccttcactagtgttttctcgtaaattctatatagcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagatgaactctgatactgtggactatgatgatgcttgcttgattgttcgatacttggcctccatgaggccgtttgcccagagctttgatatttatttgacacagatcctacgagttcttggtgaaaatgcaattgctgttcgaacaaaagccatgaagtgtttgtctgaggttgttgctgtagaccccagtattctagcaaggcttgatatgcaacgaggtgttcatggacgattgatggataattcgactagtgtccgagaagcagcagtagaattactaggtcgatttgtcctttgtcgacctcagcttgctgaacagtattatgatatgctgattgaaagaatattggatactggtatcagtgtcaggaaaagagtaataaagattctcagagacatttgtattgaacaaccaacatttccaaaaatcacagaaatgtgtgtaaaaatgattcgcagagtcaatgatgaagagggcattaagaaattagtaaatgaaacattccagaaactctggtttactccaactccacacaatgacaaagaagcaatgacaaggaaaattttaaacattaccgatgtggttgcagcatgcagagatactggatatgactggtttgagcaactgcttcaaaacttgttgaagtccgaagaggattcctcatataaacctgtgaagaaagcttgtactcaacttgttgataacctagttgagcacattcttaaatatgaggaatctctagctgactctgacaataaaggtgtgaattctggaagattggtagcttgcataaccactttgttcttattcagcaaaataagaccccagctcatggttaaacatgcaatgactatgcaaccataccttaccactaaatgtagtacgcaaaatgatttcatggttatctgcaatgttgcaaaaatcctagagctagttgtaccactgatggagcatccaagtgaaacttttcttgccactattgaggaagatctaatgaagctcatcatcaaatatggcatgactgtagtgcaacattgtgtgagctgtcttggagctgttgtaaataaagtgacacaaaattttaaatttgtgtgggcttgtttcaatagatactatggtgccatttcaaaattaaaaagtcaacaccaagaggacccaaataacacttcacttctaacaaacaaaccagcacttcttagatcccttttcaccgttggagcactatgtcggcattttgattttgatctggaagattttaaaggcaacagcaaggttaacataaaagataaagtacttgaactattgatgtattttacaaaacactcagatgaagaagtacaaacaaaagctatcattggtctaggatttgcctttattcagcatccaagtctaatgttcgagcaagaagtgaagaatctatataataatattttatctgataagaactcctcagtcaatttaaaaatacaagtgttaaaaaacctccagacctacctacaagaagaagatacacgtatgcagcaggcagatagagactggaagaaagttgcaaaacaggaagacttaaaagaaatgggtgatgtttcctcagggatgagtagttccatcatgcagctttatctcaaacaggtgcttgaggcattttttcacacccagtcaagtgtacgccactttgccctaaatgtcattgcattgactctaaatcaaggtcttattcatccagttcagtgtgtgccatatttaattgctatgggcacagacccagaacctgctatgcggaacaaggctgatcagcaacttgtggaaatagacaaaaaatatgctggattcattcatatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcagtaagcacaaaaacttattattttaagaaaataagtgctctagaaattttatggataaagtagtcattttttaaatattaccattttattagtatatgatagtaacttcattaagtgttttcttaatcttctaagttatttacaaagtacacagtcagaagtgaaggggaaattttgtatgagaataagtgtaatgaggaataatgtataattttgcctccatactgaatatcctataaactttgataacagtttctgtaagcgtatctttaaataagcaacatcactaaactaatcgctttgggaaccgattacctcaaatattgttagagaataactgttctaggtttttggctattgagatccctagttgttcaacttgatttcccttaatgaagggaagtcacttttctgtatagtagtccacttttgtgtatagtagtcctcccttatcattaaagatacatttcatgacccccagtggatgcatgaaaccatggatagtactaattattatatatacagtcatgcatcacttaatgacagggatacatttggagaaa

SEQ ID NO: 455155 - DNA, 3782 bp, Homo sapiens
cagcatcggtatcaagtcccattgttgcaggtggtttgagaaacatacatgataataaagtttctggtccgttgtctggcaattcagctaatcatcatgctgataatcctagacatggttcaagtgaggactacctacacatggtgcacaggctaagtagtgacgatggagattcttcaacaatgaggaatgctgcatcttttcccttgagatctccacagccagtatgctcccctgctggaagtgaaggaactcctaaaggctcaagaccacctttaatcctacaatctcagtctctaccttgttcatcacctcgagatgttccaccagatatcttgctagattctccagaaagaaaacaaaagaagcagaagaaaatgaaattaggcaaggatgaaaaagagcagagtgagaaagcggcaatgtatgatataattagttctccatccaaggactctactaaacttacattaagactttctcgtgtaaggtcttcagacatggaccagcaagaggatatgatttctggtgtggaaaatagcaatgtttcagaaaatgatattccttttaatgtgcagtacccaggacagacttcaaaaacacccattactccacaagatataaaccgcccactaaatgctgctcaatgtttgtcgcagcaagaacaaacagcattccttccagcaaatcaagtgcctgttttacaacagaacacttcagttgctgcaaaacaaccccagacttctgtggtacagaatcaacaacagatatcacaacagggacctatatatgatgaagtggaattggatgcattggctgaaattgagcgaatagagagagaatcagctattgaaagggagcgcttctcaaaagaagttcaagataaagataagcctttgaaaaaaagaaaacaagattcttacccacaggaggctgggggtgctacaggaggtaatagaccagcttctcaggagacgggttctacgggaaatgggtcaaggccagcattaatggttagcattgatcttcatcaggcaggaagagtggactctcaggcttctataactcaggattcagactccataaaaaagcctgaagaaatcaaacaatgtaatgatgcacctgtttctgttcttcaggaagatattgttggaagtcttaaatctacaccagaaaaccatcctgagacacctaaaaaaaagtctgatcctgagctttcaaagagtgaaatgaaacaaagtgaaagtagattagcagaatctaaaccaaatgaaaaccgattggtggagacaaaatcaagtgaaaataagttagaaactaaagttgagacccaaacagaagaacttaaacagaatgagagcagaacaactgaatgcaaacaaaacgagagcaccatagttgagcctaaacaaaatgaaaatagactgtctgacacaaaaccaaatgacaacaaacaaaataatggcagatcagaaacaacaaaatcaaggcctgaaaccccaaagcaaaagggtgaaagccggcctgagactccaaaacaaaagagtgatgggcatcctgaaaccccaaaacagaagggtgatggaaggcctgaaactccaaagcaaaaaggtgagagccgccctgaaactccaaagcaaaaaaatgaagggcgacctgaaacaccaaaacacaggcatgacaataggagggattctggaaagccatctacagagaaaaaacctgaagtgtctaaacataaacaagatactaaatctgactcacctcggttaaaatcagaacgagctgaagccttaaagcagagacctgatgggcgatctgtttctgagtcactaagacgtgaccatgataataaacaaaaatcagatgacaggggtgaatcagagcgacatcgaggggatcagtctagggttcgaagaccagaaacattgagatcctctagtagaaatgaacatggcattaaatctgatagttcaaaaactgataaactagaacgaaaacacaggcatgaatcaggggactcaagggaaagaccatcttctggggaacaaaaatcaagacctgacagtcctcgtgttaaacaaggagattctaataaatcaagatctgataaacttggttttaaatcaccaactagtaaagatgacaaaaggacagagggtaacaagagtaaagtagacactaataaagcacaccctgacaataaggcagaatttccaagttatttgttggggggcaggtctggtgcgttgaaaaattttgtcattccgaaaatcaagagggataaagatggcaatgttactcaggagacaaagaaaatggaaatgaaaggagagccgaaagacaaagtagaaaaaataggattagttgaagatctaaataaaggagctaagcctgtagttgtgctacaaaaactgtctttggatgatgttcagaaacttattaaagatagagaggacaaatcaagaagttcccttaaacctatcaagaataaaccatcaaagtcaaataaaggtagtatagatcaatcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatcctctaggaaacgacataaaaaagatgatgataaagcttgggaatatgaagagcgtgacagaagaagctctggggatcataggagaagtggccactctcatgaaggaagaaggagttcaggtggtggtcgttatcgaaaccgaagtccgtcagattctgacatggaagattattctcctcctcccagccttagtgaggttgctaggaaaatgaagaaaaaagaaaaacagaagaaaaggaaagcatatgaaccaaaactaacacctgaagaaatgatggactcttcaacttttaagagattcacagcctcaatagagaatattttggataatttggaagatatggattttactgcgtttggtgatgatgatgaaattcctcaggaactgctcttaggaaaacatcagcttaatgaacttggcagtgaatctgctaaaataaaagcaatgggtataatggataagctttcaactgacaaaactgtgaaagtcttaaatatcttggagaagaatattcaggatgggtcaaagctttccactttgttaaatcataataacgatactgaagaagaagaaaggttatggagagaccttattatggagagagttacaaaatcagcggatgcttgtcttacaactatcaacattatgacatcccctaacatgccaaaagctgtgtacattgaggatgtaattgaaagagttatacagtacactaaatttcatttgcagaatacactttatcctcagtatgatcctgtttacagattagatcctcatggaggaggcttattaagttcaaaagcaaaacgggctaaatgttctacccataagcagagagtaatagtaatgctttataacaaagtttgtgacattgttagcagcttatcagaattgctagagatacaacttcttacagacacaacaattcttcaggtttcatctatgggaataacaccattttttgtggaaaatgtcagtgaactacagttgtgtgccattaagttagtcactgcagtattctcaagatatgaaacctgaagaattgttgtgtctgtaaaaagttgtatctctagcaattctgat

SEQ ID NO: 455156 - DNA, 664 bp, Homo sapiens
atcaagcgagttggttagcgaagggattcggtgcagatggatggaccgtctgggctgcggagtccacgggcctgaaacgcggtcgctcctgacccgtcctccgcaaccctcgtcccaccaggccgcggtccccggagcaggccggcgggtggcaggaagacaccaggctgcagggggctggagaagcaacacccctctccctccccgccagagaactggagcgcggggacctcggttgcggatgctggcggcgagccgggttgctaggcgacatcgagagaggaagaggagaaagtcttcatggggtgctagagcatcttaaatgtccctctcatgcagggacatttccctgctgaacgaagagaaggcagacctcggcgagggacccgtggtcagcagcagcttctgaggactcatcccttagaaaggatgataaggtgcaaggcgtggtggctcacgcctgtaatcccagcactttgggaggccgaaatgggaggatcgcttgatcccaggagtccaagaccagcctgggcaacaaagtgagacttcatctcaaaaaaataaaaataaaaatacaaaagttagcagggcgtggtggcacgcacctgtaatcccagctactcaggagggtgaggaaggagaattgcttgaacccgggaggtgg

SEQ ID NO: 455157 - DNA, 414 bp, Homo sapiens
atcaagcgagttggttagcgaagggattcggtgcagatggatggaccgtctgggctgcggagtccacgggcctgaaacgcggtcgctcctgacccgtcctccgcaaccctcgtcccaccaggccgcggtccccggagcaggccggcgggtggcaggaagacaccaggctgcagggggctggagaagcaacacccctctccctccccgccagagaactggagcgcggggacctcggttgcggatgctggcggcgagccgggttgctaggcgacatcggtgagtgtaggcgggatgtaccgggcgtgtgggcagggctggaacccaatccggcaggcgggactggaaagacaaaaacggaagggcaggctgtcacctgcatctgcaaggtcacggacaggagcgagaggcggccgc

SEQ ID NO: 455158 - DNA, 1914 bp, Homo sapiens
gggccggcggcggcggcggcgcgcggaggagaccgcagtgcggccggcgctaggacccgcgggggcctcccaggccgcggcgcctcgcgctttcccccactccccgacccttcttcgcccccaaaatgaggaaacggagcaactcgctccaagttgtgcagccgggaccgcctcggggtgtgcagccggctcgcggaggccctcctgggggcgggcgcggggcgcggctcgggggcgccccctgagcaggtgagcccccgcttcctccgagcctggcacccccctcccgtctcagccaggatgccaacgaggcgctgggccccgggcacccagtgtatcaccaaatgcgagcacacccgccccaagccaggggagctggccttccgcaagggcgacgtggtcaccatcctggaggcctgcgagaacaagagctggtaccgcgtcaagcaccacaccagtggacaggaggggctgctggcagctggggcgctgcgggagcgggaggccctctccgcagaccccaagctcagcctcatgccgtggttccacgggaagatctcgggccaggaggctgtccagcagctgcagcctcccgaggatgggctgttcctggtgcgggagtccgcgcgccaccccggcgactacgtcctgtgcgtgagctttggccgcgacgtcatccactaccgcgtgctgcaccgcgacggccacctcacaatcgatgaggccgtgttcttctgcaacctcatggacatggtggagcattacagcaaggacaagggcgctatctgcaccaagctggtgagaccaaagcggaaacacgggaccaagtcggccgaggaggagctggccagggcgggctggttactgaacctgcagcatttgacattgggagcacagatcggagagggagagtttggagctgtcctgcagggtgagtacctggggcaaaaggtggccgtgaagaatatcaagtgtgatgtgacagcccaggccttcctggacgagacggccgtcatgacgaagatgcaacacgagaacctggtgcgtctcctgggcgtgatcctgcaccaggggctgtacattgtcatggagcacgtgagcaagggcaacctggtgaactttctgcggacccggggtcgagccctcgtgaacaccgctcagctcctgcagttttctctgcacgtggccgagggcatggagtacctggagagcaagaagcttgtgcaccgcgacctggccgcccgcaacatcctggtctcagaggacctggtggccaaggtcagcgactttggcctggccaaagccgagcggaaggggctagactcaagccggctgcccgtcaagtggacggcgcccgaggctctcaaacacgggaagttcaccagcaagtcggatgtctggagttttggggtgctgctctgggaggtcttctcatatggacgggctccgtaccctaaaatgtcactgaaagaggtgtcggaggccgtggagaaggggtaccgcatggaaccccccgagggctgtccaggccccgtgcacgtcctcatgagcagctgctgggaggcagagcccgcccgccggccacccttccgcaaactggccgagaagctggcccgggagctacgcagtgcaggtgccccagcctccgtctcagggcaggacgccgacggctccacctcgccccgaagccaggagccctgaccccacccggtggggcccttggccccagaggaccgagagagtggagagtgcggcgtgggggcactgaccaggcccaaggagggtccaggcgggcaagtcatcctcctggtgcccacagcaggggctggcccacgtagggggctctgggcggcccgtggacaccccagacctgcgaaggatgatcgcccgataaagacggattctaaggactct

SEQ ID NO: 455159 - DNA, 2077 bp, Homo sapiens
gggccggcggcggcggcggcgcgcggaggagaccgcagtgcggccggcgctaggacccgcgggggcctcccaggccgcggcgcctcgcgctttcccccactccccgacccttcttcgcccccaaaatgaggaaacggagcaactcgctccaagttgtgcagccgggaccgcctcggggtgtgcagccggctcgcggaggccctcctgggggcgggcgcggggcgcggctcgggggcgccccctgagcagaaaacaggaagaaccaggctcggtccagtggcacccagctccctacctcctgtgccagccgcctggcctgtggcaggccattcccagcgtccccgactgtgaccacttgctcagtgtgcctctcacctgcctcagtttccctctgggggcgatggcggggcgaggctctctggtttcctggcgggcatttcacggctgtgattctgctgaggaacttccccgggtgagcccccgcttcctccgagcctggcacccccctcccgtctcagccaggatgccaacgaggcgctgggccccgggcacccagtgtatcaccaaatgcgagcacacccgccccaagccaggggagctggccttccgcaagggcgacgtggtcaccatcctggaggcctgcgagaacaagagctggtaccgcgtcaagcaccacaccagtggacaggaggggctgctggcagctggggcgctgcgggagcgggaggccctctccgcagaccccaagctcagcctcatgccgtggttccacgggaagatctcgggccaggaggctgtccagcagctgcagcctcccgaggatgggctgttcctggtgcgggagtccgcgcgccaccccggcgactacgtcctgtgcgtgagctttggccgcgacgtcatccactaccgcgtgctgcaccgcgacggccacctcacaatcgatgaggccgtgttcttctgcaacctcatggacatggtggagcattacagcaaggacaagggcgctatctgcaccaagctggtgagaccaaagcggaaacacgggaccaagtcggccgaggaggagctggccagggcgggctggttactgaacctgcagcatttgacattgggagcacagatcggagagggagagtttggagctgtcctgcagggtgagtacctggggcaaaaggtggccgtgaagaatatcaagtgtgatgtgacagcccaggccttcctggacgagacggccgtcatgacgaagatgcaacacgagaacctggtgcgtctcctgggcgtgatcctgcaccaggggctgtacattgtcatggagcacgtgagcaagggcaacctggtgaactttctgcggacccggggtcgagccctcgtgaacaccgctcagctcctgcagttttctctgcacgtggccgagggcatggagtacctggagagcaagaagcttgtgcaccgcgacctggccgcccgcaacatcctggtctcagaggacctggtggccaaggtcagcgactttggcctggccaaagccgagcggaaggggctagactcaagccggctgcccgtcaagtggacggcgcccgaggctctcaaacacgggaagttcaccagcaagtcggatgtctggagttttggggtgctgctctgggaggtcttctcatatggacgggctccgtaccctaaaatgtcactgaaagaggtgtcggaggccgtggagaaggggtaccgcatggaaccccccgagggctgtccaggccccgtgcacgtcctcatgagcagctgctgggaggcagagcccgcccgccggccacccttccgcaaactggccgagaagctggcccgggagctacgcagtgcaggtgccccagcctccgtctcagggcaggacgccgacggctccacctcgccccgaagccaggagccctgaccccacccggtggggcccttggccccagaggaccgagagagtggagagtgcggcgtgggggcactgaccaggcccaaggagggtccaggcgggcaagtcatccccagacctgcgaaggatgatcgcccgataaagacggattctaaggactct

SEQ ID NO: 455160 - DNA, 2335 bp, Homo sapiens
gggccggcggcggcggcggcgcgcggaggagaccgcagtgcggccggcgctaggacccgcgggggcctcccaggccgcggcgcctcgcgctttcccccactccccgacccttcttcgcccccaaaatgaggaaacggagcaactcgctccaagttgtgcagccgggaccgcctcggggtgtgcagccggctcgcggaggccctcctgggggcgggcgcggggcgcggctcgggggcgccccctgagcagaaaacaggaagaaccaggctcggtccagtggcacccagctccctacctcctgtgccagccgcctggcctgtggcaggccattcccagcgtccccgactgtgaccacttgctcagtgtgcctctcacctgcctcagtttccctctgggggcgatggcggggcgaggctctctggtttcctggcgggcatttcacggctgtgattctgctgaggaacttccccgggtgagcccccgcttcctccgagcctggcacccccctcccgtctcagccaggatgccaacgaggcgctgggccccgggcacccagtgtatcaccaaatgcgagcacacccgccccaagccaggggagctggccttccgcaagggcgacgtggtcaccatcctggaggcctgcgagaacaagagctggtaccgcgtcaagcaccacaccagtggacaggaggggctgctggcagctggggcgctgcgggagcgggaggccctctccgcagaccccaagctcagcctcatgccgtggttccacgggaagatctcgggccaggaggctgtccagcagctgcagcctcccgaggatgggctgttcctggtgcgggagtccgcgcgccaccccggcgactacgtcctgtgcgtgagctttggccgcgacgtcatccactaccgcgtgctgcaccgcgacggccacctcacaatcgatgaggccgtgttcttctgcaacctcatggacatggtggagaggccacccgggaacggaacaggatgctggggttcccctccctggggctgggctcatggctgtcccaccatcctgcagcattacagcaaggacaagggcgctatctgcaccaagctggtgagaccaaagcggaaacacgggaccaagtcggccgaggaggagctggccaggggtccccagcttcgccactcatctgtcaccatcatccaccatctgagccagaaacctggccccgaacctccacccaccccatcctccagcattccctccttggccaggttcccaagacctgcgggctggttactgaacctgcagcatttgacattgggagcacagatcggagagggagagtttggagctgtcctgcagggtgagtacctggggcaaaaggtggccgtgaagaatatcaagtgtgatgtgacagcccaggccttcctggacgagacggccgtcatgacgaagatgcaacacgagaacctggtgcgtctcctgggcgtgatcctgcaccaggggctgtacattgtcatggagcacgtgagcaagggcaacctggtgaactttctgcggacccggggtcgagccctcgtgaacaccgctcagctcctgcagttttctctgcacgtggccgagggcatggagtacctggagagcaagaagcttgtgcaccgcgacctggccgcccgcaacatcctggtctcagaggacctggtggccaaggtcagcgactttggcctggccaaagccgagcggaaggggctagactcaagccggctgcccgtcaagtggacggcgcccgaggctctcaaacacgggaagttcaccagcaagtcggatgtctggagttttggggtgctgctctgggaggtcttctcatatggacgggctccgtaccctaaaatgtcactgaaagaggtgtcggaggccgtggagaaggggtaccgcatggaaccccccgagggctgtccaggccccgtgcacgtcctcatgagcagctgctgggaggcagagcccgcccgccggccacccttccgcaaactggccgagaagctggcccgggagctacgcagtgcaggtgccccagcctccgtctcagggcaggacgccgacggctccacctcgccccgaagccaggagccctgaccccacccggtggggcccttggccccagaggaccgagagagtggagagtgcggcgtgggggcactgaccaggcccaaggagggtccaggcgggcaagtcatcctcctggtgcccacagcaggggctggcccacgtagggggctctgggcggcccgtggacaccccagacctgcgaaggatgatcgcccgataaagacggattctaaggactct

SEQ ID NO: 455161 - DNA, 2073 bp, Homo sapiens
atcaagcgagttggttagcgaagggattcggtgcagatggatggaccgtctgggctgcggagtccacgggcctgaaacgcggtcgctcctgacccgtcctccgcaaccctcgtcccaccaggccgcggtccccggagcaggccggcgggtggcaggaagacaccaggctgcagggggctggagaagcaacacccctctccctccccgccagagaactggagcgcggggacctcggttgcggatgctggcggcgagccgggttgctaggcgacatcgagagaggaagaggagaaagtcttcatggggtgctagagcatcttaaatgtccctctcatgcagggacatttccctgctgaacgaagagaaggcagacctcggcgagggacccgtggtcagcagcagcttctggtgagcccccgcttcctccgagcctggcacccccctcccgtctcagccaggatgccaacgaggcgctgggccccgggcacccagtgtatcaccaaatgcgagcacacccgccccaagccaggggagctggccttccgcaagggcgacgtggtcaccatcctggaggcctgcgagaacaagagctggtaccgcgtcaagcaccacaccagtggacaggaggggctgctggcagctggggcgctgcgggagcgggaggccctctccgcagaccccaagctcagcctcatgccgtggttccacgggaagatctcgggccaggaggctgtccagcagctgcagcctcccgaggatgggctgttcctggtgcgggagtccgcgcgccaccccggcgactacgtcctgtgcgtgagctttggccgcgacgtcatccactaccgcgtgctgcaccgcgacggccacctcacaatcgatgaggccgtgttcttctgcaacctcatggacatggtggagcattacagcaaggacaagggcgctatctgcaccaagctggtgagaccaaagcggaaacacgggaccaagtcggccgaggaggagctggccagggcgggctggttactgaacctgcagcatttgacattgggagcacagatcggagagggagagtttggagctgtcctgcagggtgagtacctggggcaaaaggtggccgtgaagaatatcaagtgtgatgtgacagcccaggccttcctggacgagacggccgtcatgacgaagatgcaacacgagaacctggtgcgtctcctgggcgtgatcctgcaccaggggctgtacattgtcatggagcacgtgagcaagggcaacctggtgaactttctgcggacccggggtcgagccctcgtgaacaccgctcagctcctgcagttttctctgcacgtggccgagggcatggagtacctggagagcaagaagcttgtgcaccgcgacctggccgcccgcaacatcctggtctcagaggacctggtggccaaggtcagcgactttggcctggccaaagccgagcggaaggggctagactcaagccggctgcccgtcaagtggacggcgcccgaggctctcaaacacgggaagttcaccagcaagtcggatgtctggagttttggggtgctgctctgggaggtcttctcatatggacgggctccgtaccctaaaatgtcactgaaagaggtgtcggaggccgtggagaaggggtaccgcatggaaccccccgagggctgtccaggccccgtgcacgtcctcatgagcagctgctgggaggcagagcccgcccgccggccacccttccgcaaactggccgagaagctggcccgggagctacgcagtgcaggtgccccagcctccgtctcagggcaggacgccgacggctccacctcgccccgaagccaggagccctgaccccacccggtggggcccttggccccagaggaccgagagagtggagagtgcggcgtgggggcactgaccaggcccaaggagggtccaggcgggcaagtcatcctcctggtgcccacagcaggggctggcccacgtagggggctctgggcggcccgtggacaccccagacctgcgaaggatgatcgcccgataaagacggattctaaggactct

SEQ ID NO: 455162 - DNA, 1585 bp, Homo sapiens
gggccggcggcggcggcggcgcgcggaggagaccgcagtgcggccggcgctaggacccgcgggggcctcccaggccgcggcgcctcgcgctttcccccactccccgacccttcttcgcccccaaaatgaggaaacggagcaactcgctccaagttgtgcagccgggaccgcctcggggtgtgcagccggctcgcggaggccctcctgggggcgggcgcggggcgcggctcgggggcgccccctgagcagaaaacaggaagaaccaggctcggtccagtggcacccagctccctacctcctgtgccagccgcctggcctgtggcaggccattcccagcgtccccgactgtgaccacttgctcagtgtgcctctcacctgcctcagtttccctctgggggcgatggcggggcgaggctctctggtttcctggcgggcatttcacggctgtgattctgctgaggaacttccccgggtgagcccccgcttcctccgagcctggcacccccctcccgtctcagccaggatgccaacgaggcgctgggccccgggcacccagtgtatcaccaaatgcgagcacacccgccccaagccaggggagctggccttccgcaagggcgacgtggtcaccatcctggaggcctgcgagaacaagagctggtaccgcgtcaagcaccacaccagtggacaggaggggctgctggcagctggggcgctgcgggagcgggaggccctctccgcagaccccaagctcagcctcatgccgtggttccacgggaagatctcgggccaggaggctgtccagcagctgcagcctcccgaggatgggctgttcctggtgcgggagtccgcgcgccaccccggcgactacgtcctgtgcgtgagctttggccgcgacgtcatccactaccgcgtgctgcaccgcgacggccacctcacaatcgatgaggccgtgttcttctgcaacctcatggacatggtggagcattacagcaaggacaagggcgctatctgcaccaagctggtgagaccaaagcggaaacacgggaccaagtcggccgaggaggagctggccaggggtccccagcttcgccactcatctgtcaccatcatccaccatctgagccagaaacctggccccgaacctccacccaccccatcctccagcattccctccttggccaggttcccaagacctggtgaatcttctcccctcccctccccacagcccagcctcaggccctcccatcagaccgcctcattcccagagggcgagtcccccttccagcccaggccttgagtgcagcctcaaggttatctttctatcatgaaaccatgcctccagggagagaggcccagcagctccaccaccttccagaacctgcctgcatggcctgagccacctttccagcctcatctgcaaagcccttcctccacacatccaccccctcccaggtcaactgtgatcatcgttttcttcatgcctctgagccattgtatattctgttcccttcacctgaaatgcttttccagcccctaagtagtgaaatcctcaatatttaaggtcaaaagcaaatgcctcctctga

SEQ ID NO: 455163 - DNA, 2137 bp, Homo sapiens
gggccggcggcggcggcggcgcgcggaggagaccgcagtgcggccggcgctaggacccgcgggggcctcccaggccgcggcgcctcgcgctttcccccactccccgacccttcttcgcccccaaaatgaggaaacggagcaactcgctccaagttgtgcagccgggaccgcctcggggtgtgcagccggctcgcggaggccctcctgggggcgggcgcggggcgcggctcgggggcgccccctgagcagaaaacaggaagaaccaggctcggtccagtggcacccagctccctacctcctgtgccagccgcctggcctgtggcaggccattcccagcgtccccgactgtgaccacttgctcagtgtgcctctcacctgcctcagtttccctctgggggcgatggcggggcgaggctctctggtttcctggcgggcatttcacggctgtgattctgctgaggaacttccccgggtgagcccccgcttcctccgagcctggcacccccctcccgtctcagccaggatgccaacgaggcgctgggccccgggcacccagtgtatcaccaaatgcgagcacacccgccccaagccaggggagctggccttccgcaagggcgacgtggtcaccatcctggaggcctgcgagaacaagagctggtaccgcgtcaagcaccacaccagtggacaggaggggctgctggcagctggggcgctgcgggagcgggaggccctctccgcagaccccaagctcagcctcatgccgtggttccacgggaagatctcgggccaggaggctgtccagcagctgcagcctcccgaggatgggctgttcctggtgcgggagtccgcgcgccaccccggcgactacgtcctgtgcgtgagctttggccgcgacgtcatccactaccgcgtgctgcaccgcgacggccacctcacaatcgatgaggccgtgttcttctgcaacctcatggacatggtggagcattacagcaaggacaagggcgctatctgcaccaagctggtgagaccaaagcggaaacacgggaccaagtcggccgaggaggagctggccagggcgggctggttactgaacctgcagcatttgacattgggagcacagatcggagagggagagtttggagctgtcctgcagggtgagtacctggggcaaaaggtggccgtgaagaatatcaagtgtgatgtgacagcccaggccttcctggacgagacggccgtcatgacgaagatgcaacacgagaacctggtgcgtctcctgggcgtgatcctgcaccaggggctgtacattgtcatggagcacgtgagcaagggcaacctggtgaactttctgcggacccggggtcgagccctcgtgaacaccgctcagctcctgcagttttctctgcacgtggccgagggcatggagtacctggagagcaagaagcttgtgcaccgcgacctggccgcccgcaacatcctggtctcagaggacctggtggccaaggtcagcgactttggcctggccaaagccgagcggaaggggctagactcaagccggctgcccgtcaagtggacggcgcccgaggctctcaaacacgggaagttcaccagcaagtcggatgtctggagttttggggtgctgctctgggaggtcttctcatatggacgggctccgtaccctaaaatgtcactgaaagaggtgtcggaggccgtggagaaggggtaccgcatggaaccccccgagggctgtccaggccccgtgcacgtcctcatgagcagctgctgggaggcagagcccgcccgccggccacccttccgcaaactggccgagaagctggcccgggagctacgcagtgcaggtgccccagcctccgtctcagggcaggacgccgacggctccacctcgccccgaagccaggagccctgaccccacccggtggggcccttggccccagaggaccgagagagtggagagtgcggcgtgggggcactgaccaggcccaaggagggtccaggcgggcaagtcatcctcctggtgcccacagcaggggctggcccacgtagggggctctgggcggcccgtggacaccccagacctgcgaaggatgatcgcccgataaagacggattctaaggactct

SEQ ID NO: 455164 - DNA, 2215 bp, Homo sapiens
gggccggcggcggcggcggcgcgcggaggagaccgcagtgcggccggcgctaggacccgcgggggcctcccaggccgcggcgcctcgcgctttcccccactccccgacccttcttcgcccccaaaatgaggaaacggagcaactcgctccaagttgtgcagccgggaccgcctcggggtgtgcagccggctcgcggaggccctcctgggggcgggcgcggggcgcggctcgggggcgccccctgagcagaaaacaggaagaaccaggctcggtccagtggcacccagctccctacctcctgtgccagccgcctggcctgtggcaggccattcccagcgtccccgactgtgaccacttgctcagtgtgcctctcacctgcctcagtttccctctgggggcgatggcggggcgaggctctctggtttcctggcgggcatttcacggctgtgattctgctgaggaacttccccgggtgagcccccgcttcctccgagcctggcacccccctcccgtctcagccaggatgccaacgaggcgctgggccccgggcacccagtgtatcaccaaatgcgagcacacccgccccaagccaggggagctggccttccgcaagggcgacgtggtcaccatcctggaggcctgcgagaacaagagctggtaccgcgtcaagcaccacaccagtggacaggaggggctgctggcagctggggcgctgcgggagcgggaggccctctccgcagaccccaagctcagcctcatgccgtggttccacgggaagatctcgggccaggaggctgtccagcagctgcagcctcccgaggatgggctgttcctggtgcgggagtccgcgcgccaccccggcgactacgtcctgtgcgtgagctttggccgcgacgtcatccactaccgcgtgctgcaccgcgacggccacctcacaatcgatgaggccgtgttcttctgcaacctcatggacatggtggagaggccacccgggaacggaacaggatgctggggttcccctccctggggctgggctcatggctgtcccaccatcctgcagcattacagcaaggacaagggcgctatctgcaccaagctggtgagaccaaagcggaaacacgggaccaagtcggccgaggaggagctggccagggcgggctggttactgaacctgcagcatttgacattgggagcacagatcggagagggagagtttggagctgtcctgcagggtgagtacctggggcaaaaggtggccgtgaagaatatcaagtgtgatgtgacagcccaggccttcctggacgagacggccgtcatgacgaagatgcaacacgagaacctggtgcgtctcctgggcgtgatcctgcaccaggggctgtacattgtcatggagcacgtgagcaagggcaacctggtgaactttctgcggacccggggtcgagccctcgtgaacaccgctcagctcctgcagttttctctgcacgtggccgagggcatggagtacctggagagcaagaagcttgtgcaccgcgacctggccgcccgcaacatcctggtctcagaggacctggtggccaaggtcagcgactttggcctggccaaagccgagcggaaggggctagactcaagccggctgcccgtcaagtggacggcgcccgaggctctcaaacacgggaagttcaccagcaagtcggatgtctggagttttggggtgctgctctgggaggtcttctcatatggacgggctccgtaccctaaaatgtcactgaaagaggtgtcggaggccgtggagaaggggtaccgcatggaaccccccgagggctgtccaggccccgtgcacgtcctcatgagcagctgctgggaggcagagcccgcccgccggccacccttccgcaaactggccgagaagctggcccgggagctacgcagtgcaggtgccccagcctccgtctcagggcaggacgccgacggctccacctcgccccgaagccaggagccctgaccccacccggtggggcccttggccccagaggaccgagagagtggagagtgcggcgtgggggcactgaccaggcccaaggagggtccaggcgggcaagtcatcctcctggtgcccacagcaggggctggcccacgtagggggctctgggcggcccgtggacaccccagacctgcgaaggatgatcgcccgataaagacggattctaaggactct

SEQ ID NO: 455165 - DNA, 1937 bp, Homo sapiens
aggaagggccggtgtgtgcgcgagtgtgcgcgtcccgggcgcgcagcggaaaacaggaagaaccaggctcggtccagtggcacccagctccctacctcctgtgccagccgcctggcctgtggcaggccattcccagcgtccccgactgtgaccacttgctcagtgtgcctctcacctgcctcagtttccctctgggggcgatggcggggcgaggctctctggtttcctggcgggcatttcacggctgtgattctgctgaggaacttccccgggtgagcccccgcttcctccgagcctggcacccccctcccgtctcagccaggatgccaacgaggcgctgggccccgggcacccagtgtatcaccaaatgcgagcacacccgccccaagccaggggagctggccttccgcaagggcgacgtggtcaccatcctggaggcctgcgagaacaagagctggtaccgcgtcaagcaccacaccagtggacaggaggggctgctggcagctggggcgctgcgggagcgggaggccctctccgcagaccccaagctcagcctcatgccgtggttccacgggaagatctcgggccaggaggctgtccagcagctgcagcctcccgaggatgggctgttcctggtgcgggagtccgcgcgccaccccggcgactacgtcctgtgcgtgagctttggccgcgacgtcatccactaccgcgtgctgcaccgcgacggccacctcacaatcgatgaggccgtgttcttctgcaacctcatggacatggtggagcattacagcaaggacaagggcgctatctgcaccaagctggtgagaccaaagcggaaacacgggaccaagtcggccgaggaggagctggccagggcgggctggttactgaacctgcagcatttgacattgggagcacagatcggagagggagagtttggagctgtcctgcagggtgagtacctggggcaaaaggtggccgtgaagaatatcaagtgtgatgtgacagcccaggccttcctggacgagacggccgtcatgacgaagatgcaacacgagaacctggtgcgtctcctgggcgtgatcctgcaccaggggctgtacattgtcatggagcacgtgagcaagggcaacctggtgaactttctgcggacccggggtcgagccctcgtgaacaccgctcagctcctgcagttttctctgcacgtggccgagggcatggagtacctggagagcaagaagcttgtgcaccgcgacctggccgcccgcaacatcctggtctcagaggacctggtggccaaggtcagcgactttggcctggccaaagccgagcggaaggggctagactcaagccggctgcccgtcaagtggacggcgcccgaggctctcaaacacgggaagttcaccagcaagtcggatgtctggagttttggggtgctgctctgggaggtcttctcatatggacgggctccgtaccctaaaatgtcactgaaagaggtgtcggaggccgtggagaaggggtaccgcatggaaccccccgagggctgtccaggccccgtgcacgtcctcatgagcagctgctgggaggcagagcccgcccgccggccacccttccgcaaactggccgagaagctggcccgggagctacgcagtgcaggtgccccagcctccgtctcagggcaggacgccgacggctccacctcgccccgaagccaggagccctgaccccacccggtggggcccttggccccagaggaccgagagagtggagagtgcggcgtgggggcactgaccaggcccaaggagggtccaggcgggcaagtcatcctcctggtgcccacagcaggggctggcccacgtagggggctctgggcggcccgtggacaccccagacctgcgaaggatgatcgcccgataaagacggattctaaggactct

SEQ ID NO: 455166 - DNA, 2088 bp, Homo sapiens
gggccggcggcggcggcggcgcgcggaggagaccgcagtgcggccggcgctaggacccgcgggggcctcccaggccgcggcgcctcgcgctttcccccactccccgacccttcttcgcccccaaaatgaggaaacggagcaactcgctccaagttgtgcagccgggaccgcctcggggtgtgcagccggctcgcggaggccctcctgggggcgggcgcggggcgcggctcgggggcgccccctgagcagaaaacaggaagaaccaggctcggtccagtggcacccagctccctacctcctgtgccagccgcctggcctgtggcaggccattcccagcgtccccgactgtgaccacttgctcagtgtgcctctcacctgcctcagtttccctctgggggcgatggcggggcgaggctctctggtttcctggcgggcatttcacggctgtgattctgctgaggaacttccccgggtgagcccccgcttcctccgagcctggcacccccctcccgtctcagccaggatgccaacgaggcgctgggccccgggcacccagtgtatcaccaaatgcgagcacacccgccccaagccaggggagctggccttccgcaagggcgacgtggtcaccatcctggaggcctgcgagaacaagagctggtaccgcgtcaagcaccacaccagtggacaggaggggctgctggcagctggggcgctgcgggagcgggaggccctctccgcagaccccaagctcagcctcatgccgtggttccacgggaagatctcgggccaggaggctgtccagcagctgcagcctcccgaggatgggctgttcctggtgcgggagtccgcgcgccaccccggcgactacgtcctgtgcgtgagctttggccgcgacgtcatccactaccgcgtgctgcaccgcgacggccacctcacaatcgatgaggccgtgttcttctgcaacctcatggacatggtggagcattacagcaaggacaagggcgctatctgcaccaagctggtgagaccaaagcggaaacacgggaccaagtcggccgaggaggagctggccagggcgggctggttactgaacctgcagcatttgacattgggagcacagatcggagagggagagtttggagctgtcctgcagggtgagtacctggggcaaaaggtggccgtgaagaatatcaagtgtgatgtgacagcccaggccttcctggacgagacggccgtcatgacgaagatgcaacacgagaacctggtgcgtctcctgggcgtgatcctgcaccaggggctgtacattgtcatggagcacgtgagcaagggcaacctggtgaactttctgcggacccggggtcgagccctcgtgaacaccgctcagctcctgcagttttctctgcacgtggccgagggcatggagtacctggagagcaagaagcttgtgcaccgcgacctggccgcccgcaacatcctggtctcagaggacctggtggccaaggtcagcgactttggcctggccaaagccgagcggaaggggctagactcaagccggctgcccgtcaagtggacggcgcccgaggctctcaaacacgggaagttcaccagcaagtcggatgtctggagttttggggtgctgctctgggaggtcttctcatatggacgggctccgtaccctaaaatgcccccgagggctgtccaggccccgtgcacgtcctcatgagcagctgctgggaggcagagcccgcccgccggccacccttccgcaaactggccgagaagctggcccgggagctacgcagtgcaggtgccccagcctccgtctcagggcaggacgccgacggctccacctcgccccgaagccaggagccctgaccccacccggtggggcccttggccccagaggaccgagagagtggagagtgcggcgtgggggcactgaccaggcccaaggagggtccaggcgggcaagtcatcctcctggtgcccacagcaggggctggcccacgtagggggctctgggcggcccgtggacaccccagacctgcgaaggatgatcgcccgataaagacggattctaaggactct

SEQ ID NO: 455167 - DNA, 1067 bp, Homo sapiens
catgggcggagactgcaggcttctgggcctgagagggctggagctggctttccggagccgggggcggggcgcgggcgggcctcagctgtggttactggtgacaggtcgcctgactgggctcctccccgggcccgccccgacaggtttgtcttgtgaccgcgggcggccgctgcttctttcccgagcttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcagatgtttaattttttttttaacaacattaacttgtggcctctttctacacctggaaatttactcttgaataaataaaaactcgtttgtcttgtcttctgctctgcaaaaaaaaagaattggggtttatttgggggcggaaagggttgagggggatgtaaatttgtcgtaccg

SEQ ID NO: 455168 - DNA, 888 bp, Homo sapiens
  misc_feature (876)..(876): n is a, c, g, or t
catgggcggagactgcaggcttctgggcctgagagggctggagctggctttccggagccgggggcggggcgcgggcgggcctcagctgtggttactggtgacaggtcgcctgactgggctcctccccgggcccgccccgacaggtttgtcttgtgaccgcgggcggccgctgcttctttcccgagcttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgcggttccaagtggtcgggnacctctagaaca

SEQ ID NO: 455169 - DNA, 649 bp, Homo sapiens
ggtcggacccaattcattccagcgtagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcagatgtttaattttttttttaacaacattaacttgtggcctctttctacacctggaaatttactcttgaataaataaaaactcgtttgtcttgtcttctgc

SEQ ID NO: 455170 - DNA, 906 bp, Homo sapiens
acgattcctcgttccatggtgctcagaatcgttgtacatggtcaaaagctggtccatgtcaatgacatgtcgcgcacttgtggagtggatgttcctagagcgaagctgagattgtcgagcccgatgtgcgcctagggtcaagagtccgtggcccgactgtaccctggaaggagatgacttatcctggttgttgttcaactttcacgcagcgattatgtcgaggttctaaaaaataccagcttagagaccgatgattcgtgtggacttcccttgactcgtcgtcgtaaccaggttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcagatgtttaattttttttttaacaacattaacttgtggcctctttctacacctggaaatttactcttgaataaataaaaactcgtttgtcttgtcttctgctctgcaaaaaaaaagaattggggtttatttgggggcggaaagggttgagggggatgtaaatttgtcgtaccg

SEQ ID NO: 455171 - DNA, 464 bp, Homo sapiens
atcgtgcagaagattaccttcgtgcagaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcagatgtttaattttttttttaacaacattaacttgtggcctctttctacacctggaaatttactcttgaataaataaaaactcgtttgtcttgtcttctgc

SEQ ID NO: 455172 - DNA, 419 bp, Homo sapiens
tcggtaccgtagcgctgcatggtaaactgcccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgcagtttaccatgcagcgctacgaccgagctcgattctatc

SEQ ID NO: 455173 - DNA, 713 bp, Homo sapiens
ctactcgtacaagcacagtggatacgcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggaaacaaaaaaaaaaaaaaacaaaaaaaaaaaaaaaaaaaggggggggggggaaaaaaaacccgggggggggccatggccccttcttttgaaaaagggggccaagaggagagagttaaaaaaagagagaggcgcgcgaggtaaacacagggcggggggaaaccgacgcgcgcacttgggaggacccctctcggggggcgcatgggggaccacagccaatgagcgccgcgaaaaaatgggttgtgggagccggcgtgcgccgaatgcttgttttagtatccgtcgcataacacggggggacaggccgaatgaacgacgccgatcatgacaagtagaggagtgcagacgcccttgcc

SEQ ID NO: 455174 - DNA, 1222 bp, Homo sapiens
catgggcggagactgcaggcttctgggcctgagagggctggagctggctttccggagccgggggcggggcgcgggcgggcctcagctgtggttactggtgacaggtcgcctgactgggctcctccccgggcccgccccgacaggtttgtcttgtgaccgcgggcggccgctgcttctttcccgagcttggaacttcgttatccgcgatgcgtttcctggcagctacattcctgctcctggcgctcagcaccgctgcccaggccgaaccggtgcagttcaaggactgcggatctagtaggatggagataaaaaaaaaagaaaaaaaaccccagaccacacccaaccgcaccaatcgagcaaaaaacaagagaacaacaacaaagacaccaacaccaacaaaaaacaaacgaaaaacaacaaaaccaaagacaaacaaccgagagagagacggacccggtgagcccgaggacccatatgccgaaagccgagaagaggaggagagaggagagagagagacgaacccgaagaccgagagaagacgaagaaccggaagaagcgaaccgaagaaggagagacgaacccagggagaagaagcgaaggagaccctgcaaaaagaaacagaataaggaagagagtaaagaagactgagcagtagagaagagcaagagagagctcagagaggtgacagcaagcaactagggagaagaggacccaggtaacagagaaacagtaggacgacagagcagcaaagtagagccacagaagaagtgagaccggtagctagacaaaagcccaagggaggggacgagatcggaggggacgacgagagaaacgagtcggaccgaccgagtcgaaccggatcgggtctgagacgaagcgagaccagggagaaacggagagctgacggaccaaggaaagaggtgaagacccggtgaaagaggccgtgggagacggaggggagaggaggaggctaccaggaggggtgtgagagaaggcaaagaggccgccctggggaaggcgtaggaggaagccaccgcgggtggggtggaagagctacgccgaggagcgcacgaggtaggccagggggcagaaggggggagaggataggcgcagaagagggagcgtgtgccgcgagagggtggggcggcggaaaagagagagggcgtggtggtggtggagagcaggtcgagagccggagaagggtcccgcagagaggactgcc

SEQ ID NO: 455175 - DNA, 196 bp, Homo sapiens
gcggccgcctactactactactactgctcgaattcaagcttctaacgatgtacggggatcttaggtggtttcattaaatgcagcacttggttagcagatgtttaattttttttttaacaacattaacttgtggcctctttctacacctggaaatttactcttgaataaataaaaactcgtttgtcttgtcttctgc

SEQ ID NO: 455176 - DNA, 911 bp, Homo sapiens
  misc_feature (880)..(880): n is a, c, g, or t
catgggcggagactgcaggcttctgggcctgagagggctggagctggctttccggagccgggggcggggcgcgggcgggcctcagctgtggttactggtgacaggtcgcctgactgggctcctccccgggcccgccccgacaggtttgtcttgtgaccgcgggcggccgctgcttctttcccgagcttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgataactgctaggtgtttcataancgaccgtgtttattttggactgagggtaggc

SEQ ID NO: 455177 - DNA, 973 bp, Homo sapiens
catgggcggagactgcaggcttctgggcctgagagggctggagctggctttccggagccgggggcggggcgcgggcgggcctcagctgtggttactggtgacaggtcgcctgactgggctcctccccgggcccgccccgacaggtttgtcttgtgaccgcgggcggccgctgcttctttcccgagcttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgggatagggcagttaattccactcttacaaccatcaggctcaggactgggaaagggaactgggacgcccatcaggatgccatgcaccacggccttgctgcttttagactgaatattg

SEQ ID NO: 455178 - DNA, 957 bp, Homo sapiens
catgggcggagactgcaggcttctgggcctgagagggctggagctggctttccggagccgggggcggggcgcgggcgggcctcagctgtggttactggtgacaggtcgcctgactgggctcctccccgggcccgccccgacaggtttgtcttgtgaccgcgggcggccgctgcttctttcccgagcttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaagtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcagatgtttaattttttttttaacaacattaacttgtggcctctttctacacctggaaatttactcttgaataaataaaaactcgtttgtcttgtcttctgc

SEQ ID NO: 455179 - DNA, 465 bp, Homo sapiens
ctactcgtacaagcacagtggatacgcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcagatgtttaattttttttttaacaacattaacttgtggcctctttctacacctggaaatttactcttgaataaataaaaactcgtttgtcttgtcttctgc

SEQ ID NO: 455180 - DNA, 995 bp, Homo sapiens
catgggcggagactgcaggcttctgggcctgagagggctggagctggctttccggagccgggggcggggcgcgggcgggcctcagctgtggttactggtgacaggtcgcctgactgggctcctccccgggcccgccccgacaggtttgtcttgtgaccgcgggcggccgctgcttctttcccgagcttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcagatgtttaattttttttttaacaacattaacttgtggcctctttctacacctggaaatttactcttgaataaataaaaactcgtttgtcttgtcttctgc

SEQ ID NO: 455181 - DNA, 1075 bp, Homo sapiens
catgggcggagactgcaggcttctgggcctgagagggctggagctggctttccggagccgggggcggggcgcgggcgggcctcagctgtggttactggtgacaggtcgcctgactgggctcctccccgggcccgccccgacaggtttgtcttgtgaccgcgggcggccgctgcttctttcccgagcttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcagatgtttaattttttttttaacaacatacacataactggggcttttaactggattacctgataataaaatcttggttgcaacaaaaaaaaaatgtgggcggccgaagttaaaatttggggccaaagaaagagcaaccgcgaggggtgcaaaaccggcggtaaaatgttttaacaaccact

SEQ ID NO: 455182 - DNA, 1003 bp, Homo sapiens
ggtcggacccaattcattccagcgtagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcagatgtttaattttttttttaacaacattaacttgtggcctctttctacacctggaaatttactcttgaataaataaaaactcgtttgtcttgtcttctgcaaacaaaaaaaaaaaaaaacaaaaaaaaaaaaaaaaaaaggggggggggggaaaaaaaacccgggggggggccatggccccttcttttgaaaaagggggccaagaggagagagttaaaaaaagagagaggcgcgcgaggtaaacacagggcggggggaaaccgacgcgcgcacttgggaggacccctctcggggggcgcatgggggaccacagccaatgagcgccgcgaaaaaatgggttgtgggagccggcgtgcgccgaatgcttgttttagtatccgtcgcataacacggggggacaggccgaatgaacgacgccgatcatgacaagtagaggagtgcagacgcccttgcc

SEQ ID NO: 455183 - DNA, 516 bp, Homo sapiens
  misc_feature (502)..(502): n is a, c, g, or t
  misc_feature (509)..(509): n is a, c, g, or t
agaggatccccatagcgacaccgtaccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcttctctctctaatgcctcattgatacgttcnctatggnccggcta

SEQ ID NO: 455184 - DNA, 1349 bp, Homo sapiens
catgggcggagactgcaggcttctgggcctgagagggctggagctggctttccggagccgggggcggggcgcgggcgggcctcagctgtggttactggtgacaggtcgcctgactgggctcctccccgggcccgccccgacaggtttgtcttgtgaccgcgggcggccgctgcttctttcccgagcttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcagatgtttaattttttttttaacaacattaacttgtggcctctttctacacctggaaatttactcttgaataaataaaaactcgtttgtcttgtcttctgcaaacaaaaaaaaaaaaaaacaaaaaaaaaaaaaaaaaaaggggggggggggaaaaaaaacccgggggggggccatggccccttcttttgaaaaagggggccaagaggagagagttaaaaaaagagagaggcgcgcgaggtaaacacagggcggggggaaaccgacgcgcgcacttgggaggacccctctcggggggcgcatgggggaccacagccaatgagcgccgcgaaaaaatgggttgtgggagccggcgtgcgccgaatgcttgttttagtatccgtcgcataacacggggggacaggccgaatgaacgacgccgatcatgacaagtagaggagtgcagacgcccttgcc

SEQ ID NO: 455185 - DNA, 1409 bp, Homo sapiens
catgggcggagactgcaggcttctgggcctgagagggctggagctggctttccggagccgggggcggggcgcgggcgggcctcagctgtggttactggtgacaggtcgcctgactgggctcctccccgggcccgccccgacaggtttgtcttgtgaccgcgggcggccgctgcttctttcccgagcttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcataagtctatctgggggtgagagggcatgggtggagggaagaaagtggaggagaaatcagactgaaactaaatcagtgccataagataaaaggaatttcaagactgctgttttatgcctctcaacctctaaaagcatctgagaccctatttcctgagagctcagaactgttgcctttgtaatatcctttgttaaaaaaaaaaaaggttgaaggaaagaagagagagtgagactgtagagattgatttaactgtcttcattggtttttttctgtcggagtaaggaaggtccagccagacaggacctgaaggaggttgcttaggaatgtctgataacttgccctagggttattgccctgacagtggaggaaaggttccaaaccacttccactgagctgggacattacatccacagggtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcagatgtttaattttttttttaacaacattaacttgtggcctctttctacacctggaaatttactcttgaataaataaaaactcgtttgtcttgtcttctgc

SEQ ID NO: 455186 - DNA, 318 bp, Homo sapiens
cattcggggagggttaggcaaggatggagactctggggacctgctctcagccacaggggacaaagcacacctgggcaccagcctcctgggggccctggaggtgatttacaggcccaacccacgctgcatgcatgctccgggtggctggttctcagtggttgtctcatgtctctttttctgtcttaggtggtttcattaaatgcagcacttggttagcagatgtttaattttttttttaacaacattaacttgtggcctctttctacacctggaaatttactcttgaataaataaaaactcgtttgtcttgtcttctgc

SEQ ID NO: 455187 - DNA, 1836 bp, Homo sapiens
agcggagagtccccggagccgcgagctgggagcgctgtgccgggagccgggagccgagcgcgccgggctggggccggggccggagcggagcggagagggagcgcgcccgccccagccccgagtcccgccgccttccctcccgccgcagcgcgggcccaccggccgccgccccagccatggagcaagacaacagcccccgaaagatccagttcacggtcccgctgctggagccgcaccttgaccccgaggcggcggagcagattcggaggcgccgccccacccctgccaccctcgtgctgaccagtgaccagtcatccccagagatagatgaagaccggatccccaacccacatctcaagtccactttggcaatgtctccacggcaacggaagaagatgacaaggatcacacccacaatgaaagagctccagatgatggttgaacatcacctggggcaacagcagcaaggagaggaacctgagggggccgctgagagcacaggaacccaggagtcccgcccacctgggatcccagacacagaagtggagtcaaggctgggcacctctgggacagcaaaaaaaactgcagaatgcatccctaaaactcacgagagaggcagtaaggaacccagcacaaaagaaccctcaacccatataccaccactggattccaagggagccaactcggtctgagagaggaggaggtatcttgggatcaagactgcagtttgggaatgcatggacaccggatttgtttcttattccttcacttttggggaaaatctcttgtttttaaaaagtgataaatttggtgttaggtccttggcactttccttcttttccaactgggagaatcctttctccctgccttcttgccctgccctctctgtagcccccaccctcctgccaagctgcctctgggaaggaagaaacaggagctaggcagaagccttgagcagggaagagttcttcccttagccctgactttacttgctgtgggaagagagatgagggtcagataggtgggaggactaacttccagggtgccaagaaggaagaaaagccccaggttctcttttcttattgaggaacgatccgaccacctcacaggcctgccctgcagctggaagactcggcgctctaaggcctgtgccgtgtccagctgtgactgtgcggtgggctccatctgctggacaaaaggggaactgcaccatggcacttggcccatgggaaagagggtgtggtggtgtgccgatacctcctcgcctgccctccaagccccagctgccttccttttggattcccaagcttcaggatgtgttccctcttccagctgtgggaccgctgtcccttatttcaacccgttagcaacaatggatagagaacacagtggctattaatgaagaggcccatgctggagactggaagggttcccttgtcctagacattgaggggcccagataagaccaaaaccaagcataagagaagaaactgtctcagatctcacggccaggcctctctcctgctgctgtttttgattttcccaggtagtgggagagaggaaaggagggaaggcaagattctttccccctccctgctgaagcatgtggtacagaggcaagagcagagcctgagaagcgtcaggtcccacttctgccatgcagctactatgagccctcggggcctcctcctgggcctcagcttgcccagatacatacctaaatatatatatatatatatgagggagaacgcctcacccagattttatcatgctggaaagagtgtatgtatgtgaagatgcttggtcaacttgtacccagtgaacacacacagtcag

SEQ ID NO: 455188 - DNA, 393 bp, Homo sapiens
cggcacgagggggcgacagagcaagactccgtctaaaaataaataggtaaataaataaaaaataaataaatatcactggggcaactggacatggtggctcacgcctgtaatcctagcactttgggagattgaggtgggcgggttgcgtgagcccagaaggttgagagcagcctaggcaacatagagaggcagtaaggaacccagcacaaaagaaccctcaacccatataccaccactggattccaagggagccaactcggtctgagagaggaggaggtatcttgggatcaagactgcagtttgggaatgcatggacaccggatttgtttcttattccttcacttttggggaaaatctcttgtttttaaaaagtgataaatttggtgttaggtc

SEQ ID NO: 455189 - DNA, 820 bp, Homo sapiens
agcggagagtccccggagccgcgagctgggagcgctgtgccgggagccgggagccgagcgcgccgggctggggccggggccggagcggagcggagagggagcgcgcccgccccagccccgagtcccgccgccttccctcccgccgcagcgcgggcccaccggccgccgccccagccatggagcaagacaacagcccccgaaagatccagttcacggtcccgctgctggagccgcaccttgaccccgaggcggcggagcagattcggaggcgccgccccacccctgccaccctcgtgctgaccagtgaccagtcatccccagagatagatgaagaccggatccccaacccacatctcaagtccactttggcaatgtctccacggcaacggaagaagatgacaaggatcacacccacaatgaaagagctccagatgatggttgaacatcacctggggcaacagcagcaaggagaggaacctgagggggccgctgagagcacaggaacccaggagtcccgcccacctgggatcccagacacagaagtggagtcaaggctgggcacctctgggacagcaaaaaaaactgcagaatgcatccctaaaactcacgagagaggcagtaaggaacccagcacaaaagaaccctcaacccatataccaccactggattccaagggagccaactcggtctgagagaggaggaggtatcttgggatcaagactgcagtttgggaatgcatggacaccggatttgtttcttattccttcacttttggggaaaatctcttgtttttaaaaagtgataaatttggtgttaggtc

SEQ ID NO: 455190 - DNA, 5198 bp, Homo sapiens
cgggtccgggcggagcgcggggtgcggagggcggaggcggctccggcgcccgctctgcccgccgctgggtccgaccgcgctcgccttccttgcagccgcgcctcggccccatggacgccctgtgcggttccggggagctcggctccaagttctgggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtata

SEQ ID NO: 455191 - DNA, 5402 bp, Homo sapiens
cgggtccgggcggagcgcggggtgcggagggcggaggcggctccggcgcccgctctgcccgccgctgggtccgaccgcgctcgccttccttgcagccgcgcctcggccccatggacgccctgtgcggttccggggagctcggctccaagttctgggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagctgctaaaccctgaccctctgcggggctgcctgccgggcttcacctccccccaggatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtcagaagccgcctccctcgctccctgctcctccaggaattcccagcaggctctctggtgttcagggtccttgtccctcctttcccctaagcagaaaactggccctgccctgcccctgccccatttcctcctcatctgatcccccataggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtata

SEQ ID NO: 455192 - DNA, 4799 bp, Homo sapiens
cgggtccgggcggagcgcggggtgcggagggcggaggcggctccggcgcccgctctgcccgccgctgggtccgaccgcgctcgccttccttgcagccgcgcctcggccccatggacgccctgtgcggttccggggagctcggctccaagttctgggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgccggattccggccggaattc

SEQ ID NO: 455193 - DNA, 3312 bp, Homo sapiens
tagtgggaataccccaacaggccttcactcactcaagaaacacttgcaggacgatggagtgggaagggtgccatggacagggcaatgggtcagaccttgctctcttggaagtgcccccatgcagccagcagtgtcttgggagccaagctgagaatgcctgatgctaccctctgtctgttccatccctctcctaccctcaccccccactcccatttaggaccccactgggagaagggagggtgggcaggaagtgctgagccctgggtttggaggagggacagggctgggctgagaggacctgttcccaggcctaaccaaaactgtttcattcaccagcagccctagggtgaggggcttggatggaccttggaggttgggagttcattcattctagtggaacaggcagaaattaatcaaataatcatgtgtaaatagggcccataggaaggacgcaaaggcctgtgtgtgcaggccagaaaaaggctatccacacagggtggccaggacactttctcctgtaaggaagggatgcaccagccaggcctgaaagaatgagtaagagttggaggatggaggtggggcaataaggtagggagcgagctgaaaattgcaggcaaaggatataacacatgccccaaggcaggagggtacaggaggctggagtgcgtgggagggaggcagtagaaccaagatgggggtggagaacaggccgcactctgctgcactttgaggaccatgggagagcattcagtccttacccaagagcaatcaaaagccgctgaagaccttgattttggagtcagggttgggatcggcgggaggggagggggggcggtggccaggcagtgatgtcacagacacagtccttcccaggacacatctgggagcccagtaggctgagaaccagaatgcagtcagccccctcccatggaggagcacttctccaggctggggagagccccttcccctcctgccgtaccctggtggagccagcccactggccttgtaccaggtgcactcggtgagtggttggtgggagattctaaccctgggctcaggcctagctgtttgtgtgtgagctggagacccaccgagcagcagcagcagcagcagcagccgcagcagccgccaccagatttgcagcccaagccccagattccagtgtcagcctcgctgcagctggtttcctgccgtgtgcttttgtgagccgacacaaagcagatggatgtgcacagagcccagcgcacaggcccatggctccctgcgcacagcctgctgaagtcctgtgaccccggcaaggggaagggctcattagggaaggttttcagagccctgactagcagagatgaataggaccttgtgtttgatcccagaaactgcttcacttgccagaactaacagaatggctaaaataaccagccttgcaagtgtgcacatgtggtgcggtggctgtgttgggtgggttggcatgtcactgtgggcctgagcaagtacccagaagagcaggattagacgatgtgaccaggtcagggctgatggaaacctgaccacttctctcttttttgactagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtatatacacagtagtctttttgcacttgttcacaaggtttggggattaggatctttggaggaggccaagaggaagactttctacacatgtacatggttgtagttacctgaacttcagacccaagagctcttggctgcaaatattgccttcacagccaaaattccctgggtaattgccagtagctcctgctctgctgtgcagatattgtaaaacggtgagaaaggccctgaaatctgacctggggcctcttgggaaagctgctgtgaacacctccacgttaatgtcatccctcagccctctatgcctgtttctctagggactgagaagtgcatgatgcttttacttccttgctcatttcgaagtctgttccagacagttcctataaccagtgaggcctcccaaagtgctgggattacaggcgtgagccactgtgcccagcttcaacaatgacattttctaacacatggggaagggcacactgggctccacaggcactgtctttgtgcacaggccacttgcatcctgcctcctccatgaggcaatgtaaggggaactggaggcttcatgctgagtcccatcacttcctaagaaacctgctggcagagtgcctgcatgtccctcaccttattggtgtctcacagccactctggtcacagatgaagaagcaactcaagtggcagctggaccgtgacagcaccatgaggagctgagccttgtggggagagcactgtgtctggagtcccaggctgctgtgtgaccctgggcaatttgcaaaacctttctgagcctgtttcaaatgaaaatgatgcttcgtgggattgtcgtagtcaatgagggctgggcacagtggctcacacctgtaatctcagcactttgggaggccaaggagggcggatgacttgaggtgaggagttcaagaccagcctggccaacatggagaaaccctgtctctactaaaaacaaaacaaaacaaaacaaaaacaaaaatttgccggatgtggtggtgcatgcctgtaatctcagctactcgggaggctgacagagaattgcttgaactcaggaagcaaagattgcagtgagccaagattacgccaggacactccagtctgagtgacagagggagacgttgtctc

SEQ ID NO: 455194 - DNA, 659 bp, Homo sapiens
  misc_feature (41)..(41): n is a, c, g, or t
tgtaccctcccaggctgctaggatcacaggcgttacgcaantgtgcctgggagaccaagacgggtggatcacgaggtcaggagatcgagaccatcctgccaacacggtgaaccccgtctccactaaaaatacaaaaaattagccgggcgtggtggtgggcctttctgtgtcctactccttgcaggtatgaagggcctggaccccagggcagggccaccactgggacagaaaccacacaggtgttccaggcatctcccgagtgcccctccctgctcagtatgggcaccagccacagggtctgttctcaaggactgtgagaaaaaaaaaaagaaaaaaatcattgagttgacaagtttataaccacacaccatggctggatgttcctactttccttccccaagaagcccatgttctcacattcagaaagaattctgttgaataatctctgtcctcaaaccccacatctctctcctgctcagccgtcgaccttgcctgacacctcacagttcaactggagagacccccatcagcaggagattgtgctgcaggctgagcaggtctttgtggctggagaaacaaaatgttttaaaagcccagaagagggactgggtgcagtggctcacacctaatcccagcactttgggaggcggaggtgggcg

SEQ ID NO: 455195 - DNA, 460 bp, Homo sapiens
cagctgatgtgaccccatctgcccctcctgccaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggtaggagcctggcatgggctggccacactcacccctcactgtctgggagcttccagttcccctgcttcatgtctagcagcccagttcctgcatggatacccatgctcctgtctctgtatc

SEQ ID NO: 455196 - DNA, 6327 bp, Homo sapiens
cgggtccgggcggagcgcggggtgcggagggcggaggcggctccggcgcccgctctgcccgccgctgggtccgaccgcgctcgccttccttgcagccgcgcctcggccccatggacgccctgtgcggttccggggagctcggctccaagttctgggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtatatacacagtagtctttttgcacttgttcacaaggtttggggattaggatctttggaggaggccaagaggaagactttctacacatgtacatggttgtagttacctgaacttcagacccaagagctcttggctgcaaatattgccttcacagccaaaattccctgggtaattgccagtagctcctgctctgctgtgcagatattgtaaaacggtgagaaaggccctgaaatctgacctggggcctcttgggaaagctgctgtgaacacctccacgttaatgtcatccctcagccctctatgcctgtttctctagggactgagaagtgcatgatgcttttacttccttgctcatttcgaagtctgttccagacagttcctataaccagtgaggcctcccaaagtgctgggattacaggcgtgagccactgtgcccagcttcaacaatgacattttctaacacatggggaagggcacactgggctccacaggcactgtctttgtgcacaggccacttgcatcctgcctcctccatgaggcaatgtaaggggaactggaggcttcatgctgagtcccatcacttcctaagaaacctgctggcagagtgcctgcatgtccctcaccttattggtgtctcacagccactctggtcacagatgaagaagcaactcaagtggcagctggaccgtgacagcaccatgaggagctgagccttgtggggagagcactgtgtctggagtcccaggctgctgtgtgaccctgggcaatttgcaaaacctttctgagcctgtttcaaatgaaaatgatgcttcgtgggattgtcgtagtcaatgagggctgggcacagtggctcacacctgtaatctcagcactttgggaggccaaggagggcggatgacttgaggtgaggagttcaagaccagcctggccaacatggagaaaccctgtctctactaaaaacaaaacaaaacaaaacaaaaacaaaaatttgccggatgtggtggtgcatgcctgtaatctcagctactcgggaggctgacagagaattgcttgaactcaggaagcaaagattgcagtgagccaagattacgccaggacactccagtctgagtgacagagggagacgttgtctc

SEQ ID NO: 455197 - DNA, 5769 bp, Homo sapiens
aacccggtcagatggagtccaggccaggaatgagacaagtattcaggagcaatttgggagatgggcgtgtgcgccagagagacagaggagtgccaggcaacctgggtgctggcctgggtaactggaggacgatggatcttttgctgagctgatgggctcggtgggaggaggaggctgggtggggggcaaggtggtggatggagtctggtcatgtggggccagtggtgctggtgggtcctccaaggggagattcccagctagctggaagtcaaactctcgagcccaagagtttgagaccagcctgagcaacatagcaagaccctgtctctacaaaaaagctaagatattagccaggcctggtggcatacgcctagagtcctagctactcaagaggctgaggtgggaagactgcctgagcctgagaggttgaggctgccgtgagctgtgatggcaccaccgcactccagtctaggtgacagagagagaccctgtctcaaaaaaaaaaaaaaaaaaaagagagagagagacaccagtcactgggctggggccactggggcccaccctactccaatatgacctcaccaaatgaggccacgttcacaggtaccaggtgttgggagctgaacatatctttctgggagacacaacttaagctatcacagaaggggaggcctggctatgattatggctggagggctccatgtagtcgagaggagagtgtcccaacaatgaagagactcggtcatgtcaataggtgaaggtgtagagcttccagcagaggtggccagggtgaagctcagcggcaaagggggcaacagcgcagcaagttcctgaggaggcagaggaaggccagggctcgggggcaggggcagcctccgacagcctgagcaccagaaaaaggaggacaagccactggagggcagtttgtgagtggcaaggagtttgtgggtggcagggagttctcaatgggtggctaagcaagaaggcaggtagctgctgagaggggtggggggctgggatgggcctgaagggaagagaagagaggtgaagaaggccccaagagcgggggcggattagggacctagagaaggttgctaggcagtgctgggggccactgagtttggaaaggtggatttgagcggcaagagtctttgtggtcatgtggcggaatctagagcccccagcagcctaggagaaggagcagggaagtccagtcaatggaaacgtggcatttcttcccgccatatgtcaggaggtaagaaggcaggcaggtgaggctggtggtgagagcgtcatcgatagggcgtgcagcagggtccatggtggatagagaacgaggtgaaggcagagtggagccaggaggtcgtggtcttgaggcagtactgggttgaccctccctggcccaagaggttggagggggtggaggtttcagaggccaggggtgcagtggagactgcgggtaaaagcaaagggcagcagaggagggagcagccatgggggcagcactgcccacctcactcctctctcctccccacagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggtcagctggagcagggcccaggggaaaggctggccctgggcagcttgcaagaggctcgcagccaagtccacccactactgtctacctgcaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaggcttggcacagggctgggtccctgcctccagggctctgggtgcccaggcatggccagggctcattggactctaccctgacaccacctccacgctgctcaggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaagcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtata

SEQ ID NO: 455198 - DNA, 5854 bp, Homo sapiens
aacccggtcagatggagtccaggccaggaatgagacaagtattcaggagcaatttgggagatgggcgtgtgcgccagagagacagaggagtgccaggcaacctgggtgctggcctgggtaactggaggacgatggatcttttgctgagctgatgggctcggtgggaggaggaggctgggtggggggcaaggtggtggatggagtctggtcatgtggggccagtggtgctggtgggtcctccaaggggagattcccagctagctggaagtcaaactctcgagcccaagagtttgagaccagcctgagcaacatagcaagaccctgtctctacaaaaaagctaagatattagccaggcctggtggcatacgcctagagtcctagctactcaagaggctgaggtgggaagactgcctgagcctgagaggttgaggctgccgtgagctgtgatggcaccaccgcactccagtctaggtgacagagagagaccctgtctcaaaaaaaaaaaaaaaaaaaagagagagagagacaccagtcactgggctggggccactggggcccaccctactccaatatgacctcaccaaatgaggccacgttcacaggtaccaggtgttgggagctgaacatatctttctgggagacacaacttaagctatcacagaaggggaggcctggctatgattatggctggagggctccatgtagtcgagaggagagtgtcccaacaatgaagagactcggtcatgtcaataggtgaaggtgtagagcttccagcagaggtggccagggtgaagctcagcggcaaagggggcaacagcgcagcaagttcctgaggaggcagaggaaggccagggctcgggggcaggggcagcctccgacagcctgagcaccagaaaaaggaggacaagccactggagggcagtttgtgagtggcaaggagtttgtgggtggcagggagttctcaatgggtggctaagcaagaaggcaggtagctgctgagaggggtggggggctgggatgggcctgaagggaagagaagagaggtgaagaaggccccaagagcgggggcggattagggacctagagaaggttgctaggcagtgctgggggccactgagtttggaaaggtggatttgagcggcaagagtctttgtggtcatgtggcggaatctagagcccccagcagcctaggagaaggagcagggaagtccagtcaatggaaacgtggcatttcttcccgccatatgtcaggaggtaagaaggcaggcaggtgaggctggtggtgagagcgtcatcgatagggcgtgcagcagggtccatggtggatagagaacgaggtgaaggcagagtggagccaggaggtcgtggtcttgaggcagtactgggttgaccctccctggcccaagaggttggagggggtggaggtttcagaggccaggggtgcagtggagactgcgggtaaaagcaaagggcagcagaggagggagcagccatgggggcagcactgcccacctcactcctctctcctccccacagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggtcagctggagcagggcccaggggaaaggctggccctgggcagcttgcaagaggctcgcagccaagtccacccactactgtctacctgcaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaggcttggcacagggctgggtccctgcctccagggctctgggtgcccaggcatggccagggctcattggactctaccctgacaccacctccacgctgctcaggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaaggtgaggcctgccagaggctaagggggctaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtata

SEQ ID NO: 455199 - DNA, 5534 bp, Homo sapiens
aatccagaatgatagaaagaaaatgagcctgggagggatgaactgcagaggaccataaggtaacatgggagcagttttgcaggtgtatacaactgtcaaaactcactgattgtacactttaattgggtgcagtttttgttgcccttaaattatgcctcaattagagagaaagagagagaatataaggaaatgggggcagccatggcgtccttggagaattcacacttgggacgacaactgctcatttgtgtactctctcctcctcacctgtcttccactccacccctgtctctgatggaacatctctccagctaagccatcttcctcaaggcagcccaattctctgtggggctgccacagcactaaactgttctctgtgtccccaggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaggcttggcacagggctgggtccctgcctccagggctctgggtgcccaggcatggccagggctcattggactctaccctgacaccacctccacgctgctcaggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtata

SEQ ID NO: 455200 - DNA, 5440 bp, Homo sapiens
gagggggcaccagtgtaacacaggaatgagccaagatgccaccactgttggaccatcatgtgagggtagggggctgttccacagcacccacccaccaagtgcaatatctgacgtgggtgtcagtcagtgcctgtgtaatgaacacatgtatgcagacaagtgtgaagagttctggcttacctagaggtcccattagcatgttcccttcctttcttcccacctccctcagttcctggccttcctcttgatcttcagtggctgtgatgttgggctggtgggatggaacactgcaggccaacctagtgcctcccatttctccatctcagcgggaagcaggcaaggagagtagcaaagaacataggctgtgaacaacccacttactccccatgtgggctcgggcgggtcgctgaaacctttggagcctcatttccttaattgcagaaagggcgtcatgagctgtcctgcctgtaggctgatgtcccagttagacaaggtcatgtaggtaaggtgatggcaccacacctggcacaggtgccacacctggtcctcgctgaaccagagctcccttgtgatccttcctcatctctcagagtcctctgagtggggacctggaggcccccaggtgctgcctcctgccccagaggagactgatgccccaagggactccgcagggcaggggctgcaggcccaggcttttccagtgcttctgacgcccctccactctcccacccagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaggcttggcacagggctgggtccctgcctccagggctctgggtgcccaggcatggccagggctcattggactctaccctgacaccacctccacgctgctcaggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtata

SEQ ID NO: 455201 - DNA, 4820 bp, Homo sapiens
  misc_feature (3268)..(3268): n is a, c, g, or t
aacccggtcagatggagtccaggccaggaatgagacaagtattcaggagcaatttgggagatgggcgtgtgcgccagagagacagaggagtgccaggcaacctgggtgctggcctgggtaactggaggacgatggatcttttgctgagctgatgggctcggtgggaggaggaggctgggtggggggcaaggtggtggatggagtctggtcatgtggggccagtggtgctggtgggtcctccaaggggagattcccagctagctggaagtcaaactctcgagcccaagagtttgagaccagcctgagcaacatagcaagaccctgtctctacaaaaaagctaagatattagccaggcctggtggcatacgcctagagtcctagctactcaagaggctgaggtgggaagactgcctgagcctgagaggttgaggctgccgtgagctgtgatggcaccaccgcactccagtctaggtgacagagagagaccctgtctcaaaaaaaaaaaaaaaaaaaagagagagagagacaccagtcactgggctggggccactggggcccaccctactccaatatgacctcaccaaatgaggccacgttcacaggtaccaggtgttgggagctgaacatatctttctgggagacacaacttaagctatcacagaaggggaggcctggctatgattatggctggagggctccatgtagtcgagaggagagtgtcccaacaatgaagagactcggtcatgtcaataggtgaaggtgtagagcttccagcagaggtggccagggtgaagctcagcggcaaagggggcaacagcgcagcaagttcctgaggaggcagaggaaggccagggctcgggggcaggggcagcctccgacagcctgagcaccagaaaaaggaggacaagccactggagggcagtttgtgagtggcaaggagtttgtgggtggcagggagttctcaatgggtggctaagcaagaaggcaggtagctgctgagaggggtggggggctgggatgggcctgaagggaagagaagagaggtgaagaaggccccaagagcgggggcggattagggacctagagaaggttgctaggcagtgctgggggccactgagtttggaaaggtggatttgagcggcaagagtctttgtggtcatgtggcggaatctagagcccccagcagcctaggagaaggagcagggaagtccagtcaatggaaacgtggcatttcttcccgccatatgtcaggaggtaagaaggcaggcaggtgaggctggtggtgagagcgtcatcgatagggcgtgcagcagggtccatggtggatagagaacgaggtgaaggcagagtggagccaggaggtcgtggtcttgaggcagtactgggttgaccctccctggcccaagaggttggagggggtggaggtttcagaggccaggggtgcagtggagactgcgggtaaaagcaaagggcagcagaggagggagcagccatgggggcagcactgcccacctcactcctctctcctccccacagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggtcagctggagcagggcccaggggaaaggctggccctgggcagcttgcaagaggctcgcagccaagtccacccactactgtctacctgcaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcaggtgactctccaaccctgacctctgcctccttcctctgacatgctgcagaagtggcaagagaggattattctggaactgggagcatggcacatgcttgtagtcccagctgctcaggcggctgaggcaagaggatcacttgagcccaagagttctggctgcagtgcgccacgattgtgcctgcgaatagccaccacactccagcctgggcaacatagcaagaccttgtctctaaaaagaaacaaagaaaacagaaaaaaagaaggagggttattctgggttagcagaggggatatagaattgacacaagagctggctgggcacggtggctcacgcctgtaatcccagcattttgggagaccaaggcgggtggatcacgaggtcaggagttcgagaccagcccggccaggatggtgaaaccccatctctactaaaaatacaaaaattagccagacgtggtggcgggtgcctgtagtcacagctactcaggaggctgaggcaggagaatcgcttgaacccaggaggcagaggttgcagtgagccaagatcacgccactgcactccagcctgggtgacagagcgagactccatctcaagagagaaaaaaaaaaagtccagaggagttttcttgctttggggtgttgtagaaatgatcttggagcttagccccaaaggacaaacagaatttctcttgtctctgggcaagttgtaggctcatgtgacaggtcaggacagtgtagggctggcataccgctcgctcacgttcacatgcttgcagagaacgtacacagacgaggtgactgaagcctggtctgcaggtcaggcaggtcatcctgatgccagcttgtactgtcaaagagtcacctaactgcaaacggaatttttgtaaagcagatcacattgttaatacctcaggtggctcaaaccttgaacgcgttggcaaacaaaaaacaatccagaaaggtcaattttcacaaaggtcagtgtgcacatgaatctacttgttaaaatgtacattttgattcagtagacctaggatggggctcaggactctgcactttgatcaagactccttggtacgcaaagtgtggcccatgggccagttgcatcaccatcctctgggagcttgttagaaatgaagaatctcaggttccaagtcccacctcagactacagaatccggcgttgcattttaacaagattctctgggaagtcttatacatattaaagttggagaaacagaaaccaaggcgaggtggtccttggttaagtctgcactgtcactgcccaagggagtcattcgngattacagccccagctggcatgcctgtgggcttgatccaggcccacctgggtcatccatgggctaggatcccatggatgggcacatgatccaggagtctgaactcctcccaaagccattacggtggggaggggagatcgccatacgtataacccagtccctttggccaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtata

SEQ ID NO: 455202 - DNA, 5769 bp, Homo sapiens
aacccggtcagatggagtccaggccaggaatgagacaagtattcaggagcaatttgggagatgggcgtgtgcgccagagagacagaggagtgccaggcaacctgggtgctggcctgggtaactggaggacgatggatcttttgctgagctgatgggctcggtgggaggaggaggctgggtggggggcaaggtggtggatggagtctggtcatgtggggccagtggtgctggtgggtcctccaaggggagattcccagctagctggaagtcaaactctcgagcccaagagtttgagaccagcctgagcaacatagcaagaccctgtctctacaaaaaagctaagatattagccaggcctggtggcatacgcctagagtcctagctactcaagaggctgaggtgggaagactgcctgagcctgagaggttgaggctgccgtgagctgtgatggcaccaccgcactccagtctaggtgacagagagagaccctgtctcaaaaaaaaaaaaaaaaaaaagagagagagagacaccagtcactgggctggggccactggggcccaccctactccaatatgacctcaccaaatgaggccacgttcacaggtaccaggtgttgggagctgaacatatctttctgggagacacaacttaagctatcacagaaggggaggcctggctatgattatggctggagggctccatgtagtcgagaggagagtgtcccaacaatgaagagactcggtcatgtcaataggtgaaggtgtagagcttccagcagaggtggccagggtgaagctcagcggcaaagggggcaacagcgcagcaagttcctgaggaggcagaggaaggccagggctcgggggcaggggcagcctccgacagcctgagcaccagaaaaaggaggacaagccactggagggcagtttgtgagtggcaaggagtttgtgggtggcagggagttctcaatgggtggctaagcaagaaggcaggtagctgctgagaggggtggggggctgggatgggcctgaagggaagagaagagaggtgaagaaggccccaagagcgggggcggattagggacctagagaaggttgctaggcagtgctgggggccactgagtttggaaaggtggatttgagcggcaagagtctttgtggtcatgtggcggaatctagagcccccagcagcctaggagaaggagcagggaagtccagtcaatggaaacgtggcatttcttcccgccatatgtcaggaggtaagaaggcaggcaggtgaggctggtggtgagagcgtcatcgatagggcgtgcagcagggtccatggtggatagagaacgaggtgaaggcagagtggagccaggaggtcgtggtcttgaggcagtactgggttgaccctccctggcccaagaggttggagggggtggaggtttcagaggccaggggtgcagtggagactgcgggtaaaagcaaagggcagcagaggagggagcagccatgggggcagcactgcccacctcactcctctctcctccccacagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggtcagctggagcagggcccaggggaaaggctggccctgggcagcttgcaagaggctcgcagccaagtccacccactactgtctacctgcaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaggcttggcacagggctgggtccctgcctccagggctctgggtgcccaggcatggccagggctcattggactctaccctgacaccacctccacgctgctcaggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcgaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtata

SEQ ID NO: 455203 - DNA, 5064 bp, Homo sapiens
aacccggtcagatggagtccaggccaggaatgagacaagtattcaggagcaatttgggagatgggcgtgtgcgccagagagacagaggagtgccaggcaacctgggtgctggcctgggtaactggaggacgatggatcttttgctgagctgatgggctcggtgggaggaggaggctgggtggggggcaaggtggtggatggagtctggtcatgtggggccagtggtgctggtgggtcctccaaggggagattcccagctagctggaagtcaaactctcgagcccaagagtttgagaccagcctgagcaacatagcaagaccctgtctctacaaaaaagctaagatattagccaggcctggtggcatacgcctagagtcctagctactcaagaggctgaggtgggaagactgcctgagcctgagaggttgaggctgccgtgagctgtgatggcaccaccgcactccagtctaggtgacagagagagaccctgtctcaaaaaaaaaaaaaaaaaaaagagagagagagacaccagtcactgggctggggccactggggcccaccctactccaatatgacctcaccaaatgaggccacgttcacaggtaccaggtgttgggagctgaacatatctttctgggagacacaacttaagctatcacagaaggggaggcctggctatgattatggctggagggctccatgtagtcgagaggagagtgtcccaacaatgaagagactcggtcatgtcaataggtgaaggtgtagagcttccagcagaggtggccagggtgaagctcagcggcaaagggggcaacagcgcagcaagttcctgaggaggcagaggaaggccagggctcgggggcaggggcagcctccgacagcctgagcaccagaaaaaggaggacaagccactggagggcagtttgtgagtggcaaggagtttgtgggtggcagggagttctcaatgggtggctaagcaagaaggcaggtagctgctgagaggggtggggggctgggatgggcctgaagggaagagaagagaggtgaagaaggccccaagagcgggggcggattagggacctagagaaggttgctaggcagtgctgggggccactgagtttggaaaggtggatttgagcggcaagagtctttgtggtcatgtggcggaatctagagcccccagcagcctaggagaaggagcagggaagtccagtcaatggaaacgtggcatttcttcccgccatatgtcaggaggtaagaaggcaggcaggtgaggctggtggtgagagcgtcatcgatagggcgtgcagcagggtccatggtggatagagaacgaggtgaaggcagagtggagccaggaggtcgtggtcttgaggcagtactgggttgaccctccctggcccaagaggttggagggggtggaggtttcagaggccaggggtgcagtggagactgcgggtaaaagcaaagggcagcagaggagggagcagccatgggggcagcactgcccacctcactcctctctcctccccacagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggtcagctggagcagggcccaggggaaaggctggccctgggcagcttgcaagaggctcgcagccaagtccacccactactgtctacctgcaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaggcttggcacagggctgggtccctgcctccagggctctgggtgcccaggcatggccagggctcattggactctaccctgacaccacctccacgctgctcaggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtcagaagccgcctccctcgctccctgctcctccaggaattcccagcaggctctctggtgttcagggtccttgtccctcctttcccctaagcagaaaactggccctgccctgcccctgccccatttcctcctcatctgatcccccataggtggctgagcatcggagtggagttcgtggggaactgcgtggtgctctttgctgcactatttgccgtcatcgggaggagcagcctgaacccggggctggtgggcctttctgtgtcctactccttgcaggtatgaagggcctggaccccagggcagggccaccactgggacagaaaccacacaggtgttccaggcatctcccgagtgcccctccctgctcagtatgggcaccagccacagggtctgttctcaaggactgtgagaaaaaaaaaaagaaaaaaatcattgagttgacaagtttataaccacacaccatggctggatgttcctactttccttccccaagaagcccatgttctcacattcagaaagaattctgttgaataatctctgtcctcaaaccccacatctctctcctgctcagccgtcgaccttgcctgacacctcacagttcaactggagagacccccatcagcaggagattgtgctgcaggctgagcaggtctttgtggctggagaaacaaaatgttttaaaagcccagaagagggactgggtgcagtggctcacacctaatcccagcactttgggaggcggaggtgggcg

SEQ ID NO: 455204 - DNA, 3926 bp, Homo sapiens
  misc_feature (3804)..(3804): n is a, c, g, or t
  misc_feature (3808)..(3808): n is a, c, g, or t
  misc_feature (3813)..(3814): n is a, c, g, or t
aacccggtcagatggagtccaggccaggaatgagacaagtattcaggagcaatttgggagatgggcgtgtgcgccagagagacagaggagtgccaggcaacctgggtgctggcctgggtaactggaggacgatggatcttttgctgagctgatgggctcggtgggaggaggaggctgggtggggggcaaggtggtggatggagtctggtcatgtggggccagtggtgctggtgggtcctccaaggggagattcccagctagctggaagtcaaactctcgagcccaagagtttgagaccagcctgagcaacatagcaagaccctgtctctacaaaaaagctaagatattagccaggcctggtggcatacgcctagagtcctagctactcaagaggctgaggtgggaagactgcctgagcctgagaggttgaggctgccgtgagctgtgatggcaccaccgcactccagtctaggtgacagagagagaccctgtctcaaaaaaaaaaaaaaaaaaaagagagagagagacaccagtcactgggctggggccactggggcccaccctactccaatatgacctcaccaaatgaggccacgttcacaggtaccaggtgttgggagctgaacatatctttctgggagacacaacttaagctatcacagaaggggaggcctggctatgattatggctggagggctccatgtagtcgagaggagagtgtcccaacaatgaagagactcggtcatgtcaataggtgaaggtgtagagcttccagcagaggtggccagggtgaagctcagcggcaaagggggcaacagcgcagcaagttcctgaggaggcagaggaaggccagggctcgggggcaggggcagcctccgacagcctgagcaccagaaaaaggaggacaagccactggagggcagtttgtgagtggcaaggagtttgtgggtggcagggagttctcaatgggtggctaagcaagaaggcaggtagctgctgagaggggtggggggctgggatgggcctgaagggaagagaagagaggtgaagaaggccccaagagcgggggcggattagggacctagagaaggttgctaggcagtgctgggggccactgagtttggaaaggtggatttgagcggcaagagtctttgtggtcatgtggcggaatctagagcccccagcagcctaggagaaggagcagggaagtccagtcaatggaaacgtggcatttcttcccgccatatgtcaggaggtaagaaggcaggcaggtgaggctggtggtgagagcgtcatcgatagggcgtgcagcagggtccatggtggatagagaacgaggtgaaggcagagtggagccaggaggtcgtggtcttgaggcagtactgggttgaccctccctggcccaagaggttggagggggtggaggtttcagaggccaggggtgcagtggagactgcgggtaaaagcaaagggcagcagaggagggagcagccatgggggcagcactgcccacctcactcctctctcctccccacagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggtcagctggagcagggcccaggggaaaggctggccctgggcagcttgcaagaggctcgcagccaagtccacccactactgtctacctgcaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaggcttggcacagggctgggtccctgcctccagggctctgggtgcccaggcatggccagggctcattggactctaccctgacaccacctccacgctgctcaggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaaggtgaggcctgccagaggctaagggggctaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggggggntagnggtannatcgcaggtctgggatgtgcagcagcaagaggggatccagcgccgtgtgccggcggtgcaagaatcccactttgaacacacagggcaaggtccgaatatgaagggcgccgga

SEQ ID NO: 455205 - DNA, 423 bp, Homo sapiens
ggacagacgccacgtggacagacgccacgtggacagacgccacgtggacaacgccacggattcagaaccctgagtacaagggtgggtggaagccccggcagatcgacaacccagattacaagggcacttagatccacccagaaattgacatccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtata

SEQ ID NO: 455206 - DNA, 998 bp, Homo sapiens
gagggggcaccagtgtaacacaggaatgagccaagatgccaccactgttggaccatcatgtgagggtagggggctgttccacagcacccacccaccaagtgcaatatctgacgtgggtgtcagtcagtgcctgtgtaatgaacacatgtatgcagacaagtgtgaagagttctggcttacctagaggtcccattagcatgttcccttcctttcttcccacctccctcagttcctggccttcctcttgatcttcagtggctgtgatgttgggctggtgggatggaacactgcaggccaacctagtgcctcccatttctccatctcagcgggaagcaggcaaggagagtagcaaagaacataggctgtgaacaacccacttactccccatgtgggctcgggcgggtcgctgaaacctttggagcctcatttccttaattgcagaaagggcgtcatgagctgtcctgcctgtaggctgatgtcccagttagacaaggtcatgtaggtaaggtgatggcaccacacctggcacaggtgccacacctggtcctcgctgaaccagagctcccttgtgatccttcctcatctctcagagtcctctgagtggggacctggaggcccccaggtgctgcctcctgccccagaggagactgatgccccaagggactccgcagggcaggggctgcaggcccaggcttttccagtgcttctgacgcccctccactctcccacccagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagtgagttggctcttccaccagccaggccagagggaggggagggatggaaggtgagatggagaaaggggagcagggca

SEQ ID NO: 455207 - DNA, 219 bp, Homo sapiens
caccttctacatccactttgccctggtactctctgccctcatcttggcctgcttcagggagaaacctccatttttctccgcaaagaatgtcgaccctgtgagtttcccatggagggtgcgggggctccacagctgagtcctcagcccaactctgaccagcagcccccaacccctccagttcctttcaaagtgggagagaggtcatccccacaatctgta

SEQ ID NO: 455208 - DNA, 188 bp, Homo sapiens
tacctgtgggtcgccctgccctgctacttgctctacctgcggcaccattgtcgtggctacatcatcctctcccacctgtccaagctcaagatggtcagtggctcagggatctcctaccgatggggctgggccctggggattctgcttttattttttaatttaattaaattaattaattaattaattta

SEQ ID NO: 455209 - DNA, 433 bp, Homo sapiens
cccaagagctcttggctgcaaatattgccttcacagccaaaattccctgggtaattgccagtagctcctgctctgctgtgcagatattgtaaaacggtgagaaaggccctgaaatctgacctggggcctcttgggaaagctgctgtgaacacctccacgttaatgtcatccctcagccctctatgcctgtttctctagggactgagaagtgcatgatgcttttacttccttgctcatttcgaagtctgttccagacagttcctataaccagtgaggcctccaagtcattcattttcctcagtctagccaaagctgaatgtgtgagcacaaagaagccgagaggccacctcctgcccagagagaagccacccacactcccaggttggcagacaagatgtgaggggtgaattaaatttgttttcttgagcaagcc

SEQ ID NO: 455210 - DNA, 5347 bp, Homo sapiens
cgggtccgggcggagcgcggggtgcggagggcggaggcggctccggcgcccgctctgcccgccgctgggtccgaccgcgctcgccttccttgcagccgcgcctcggccccatggacgccctgtgcggttccggggagctcggctccaagttctgggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtcagaagccgcctccctcgctccctgctcctccaggaattcccagcaggctctctggtgttcagggtccttgtccctcctttcccctaagcagaaaactggccctgccctgcccctgccccatttcctcctcatctgatcccccataggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtata

SEQ ID NO: 455211 - DNA, 656 bp, Homo sapiens
ggcctatggctcctcatagggcctaagctgcctccctctgaggccacgttgtatccccaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcaggtaaacactgggagtgcagaggtcaggaactgcaaccctccctgggaaaccctggcgggtgctgggaaacctgacaccaatgacacagagatgaggccagcccggatgtgcacagggctgtcctttcgtattgagcatattccgtgtgccaggcatggtgtactgccccgccgactcctcacacaagccccagcggtggtccatgatcccacttcaccggtcagggaactgaggctcagagatggtaaagggcttgacctaagttgcacagctgggagaaggcaggtctgggatttgaaccagctctgggagattccttatgtcctcagccactgggctatgcactggaggggccagtagtcacctcttactgagtctaaaggttggagatacctatacctgtgctagctgtgtgatttggggctagtt

SEQ ID NO: 455212 - DNA, 423 bp, Homo sapiens
ctatctgtttggccaaccaccatcttttgcttcctgcccatctacacatttcaagttaacaggcctctgtttgcctgttgggttctctctgtagactttggtaatctgtccctatgtgtcatctatccaccggtgcctcctcagaacctaggtccctctgtcctggctggagtcgctttcatggtcttgctgattccactcaacggagctgtggccgtgaagatgcgcgccttccaggtaggtgctgtcagaggtgcatcctcctgcctgcagcacccggccggctgcctgggggaaggtgtccactaaccttggggcctcccaactaccttgcttcctgagtatggatggctactagcatgcactccgccagcatcactccgcagcatcactcgccgccatgcactccgccaccatctccgg

SEQ ID NO: 455213 - DNA, 5823 bp, Homo sapiens
aacccggtcagatggagtccaggccaggaatgagacaagtattcaggagcaatttgggagatgggcgtgtgcgccagagagacagaggagtgccaggcaacctgggtgctggcctgggtaactggaggacgatggatcttttgctgagctgatgggctcggtgggaggaggaggctgggtggggggcaaggtggtggatggagtctggtcatgtggggccagtggtgctggtgggtcctccaaggggagattcccagctagctggaagtcaaactctcgagcccaagagtttgagaccagcctgagcaacatagcaagaccctgtctctacaaaaaagctaagatattagccaggcctggtggcatacgcctagagtcctagctactcaagaggctgaggtgggaagactgcctgagcctgagaggttgaggctgccgtgagctgtgatggcaccaccgcactccagtctaggtgacagagagagaccctgtctcaaaaaaaaaaaaaaaaaaaagagagagagagacaccagtcactgggctggggccactggggcccaccctactccaatatgacctcaccaaatgaggccacgttcacaggtaccaggtgttgggagctgaacatatctttctgggagacacaacttaagctatcacagaaggggaggcctggctatgattatggctggagggctccatgtagtcgagaggagagtgtcccaacaatgaagagactcggtcatgtcaataggtgaaggtgtagagcttccagcagaggtggccagggtgaagctcagcggcaaagggggcaacagcgcagcaagttcctgaggaggcagaggaaggccagggctcgggggcaggggcagcctccgacagcctgagcaccagaaaaaggaggacaagccactggagggcagtttgtgagtggcaaggagtttgtgggtggcagggagttctcaatgggtggctaagcaagaaggcaggtagctgctgagaggggtggggggctgggatgggcctgaagggaagagaagagaggtgaagaaggccccaagagcgggggcggattagggacctagagaaggttgctaggcagtgctgggggccactgagtttggaaaggtggatttgagcggcaagagtctttgtggtcatgtggcggaatctagagcccccagcagcctaggagaaggagcagggaagtccagtcaatggaaacgtggcatttcttcccgccatatgtcaggaggtaagaaggcaggcaggtgaggctggtggtgagagcgtcatcgatagggcgtgcagcagggtccatggtggatagagaacgaggtgaaggcagagtggagccaggaggtcgtggtcttgaggcagtactgggttgaccctccctggcccaagaggttggagggggtggaggtttcagaggccaggggtgcagtggagactgcgggtaaaagcaaagggcagcagaggagggagcagccatgggggcagcactgcccacctcactcctctctcctccccacagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggtcagctggagcagggcccaggggaaaggctggccctgggcagcttgcaagaggctcgcagccaagtccacccactactgtctacctgcaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaggcttggcacagggctgggtccctgcctccagggctctgggtgcccaggcatggccagggctcattggactctaccctgacaccacctccacgctgctcaggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtata

SEQ ID NO: 455214 - DNA, 5936 bp, Homo sapiens
cacaaagcctgggtgcctgtcccggccacacactgctgggtgtccttgaacctgttgccaaagtgggtgtagtttctcttttgtacactgggcctaacagtgcccctcctatatacccctggaagttgttctgagacaacatccagataacaactaggtaagtgcagtaataaaatgcgggagaaacattaggggcctttattttcctcacttaactggctgccagggaaaagcaaggaaaggtcagaggctggggtgccccagagaggccccatgtagatgaggctctggctgggcccagagaaatgggatgtacactccggcccagagacctgaagatctgggttcagggcagctttgggacaggctatctggatggcaactaactggagtacctgatcaggcctagaggtgtgtcctgtgacccagtgtccaggcctgggccagcatgtcagagactcagcaagagtatgtgggtccttggctcacattgtttgagcaactactgaatactgaataggactactgaatactgaatactgaataggacaagatgtacatggtacaacttctgcccacctgggccttcaatgaaatgcccccaggcagcatgtccctgactgcatgcttcacagagcagggataggcctgcccaacgtgccactgtatctgcagaacccagcccactgcctgactcaccaaggccctcaccaaacattgtcaaggccaagagtgacgctccagggaaggggatctctctaggaggaagggtgctcaagatgaagaaggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaggcttggcacagggctgggtccctgcctccagggctctgggtgcccaggcatggccagggctcattggactctaccctgacaccacctccacgctgctcaggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtata

SEQ ID NO: 455215 - DNA, 5416 bp, Homo sapiens
cgggtccgggcggagcgcggggtgcggagggcggaggcggctccggcgcccgctctgcccgccgctgggtccgaccgcgctcgccttccttgcagccgcgcctcggccccatggacgccctgtgcggttccggggagctcggctccaagttctggaacccagcccactgcctgactcaccaaggccctcaccaaacattgtcaaggccaagagtgacgctccagggaaggggatctctctaggaggaagggtgctcaagatgaagaaggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaggcttggcacagggctgggtccctgcctccagggctctgggtgcccaggcatggccagggctcattggactctaccctgacaccacctccacgctgctcaggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtata

SEQ ID NO: 455216 - DNA, 2724 bp, Homo sapiens
gccaccacgcctggctaatttttgtatttttagtacagacatggtttcaccatgttggccaggatggtctcgatctcttgacctcgtgatctgcctgcctcggcctcccaaagtgctgggattacaggtgtgagccaccttgcccgatctcagagcctgttttccatctgttgaaagcataggagggcccaggcccagcttgtgtggcaaggctgcttcatggataaatagtttgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtata

SEQ ID NO: 455217 - DNA, 4300 bp, Homo sapiens
  misc_feature (2748)..(2748): n is a, c, g, or t
cgggtccgggcggagcgcggggtgcggagggcggaggcggctccggcgcccgctctgcccgccgctgggtccgaccgcgctcgccttccttgcagccgcgcctcggccccatggacgccctgtgcggttccggggagctcggctccaagttctgggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcaggtgactctccaaccctgacctctgcctccttcctctgacatgctgcagaagtggcaagagaggattattctggaactgggagcatggcacatgcttgtagtcccagctgctcaggcggctgaggcaagaggatcacttgagcccaagagttctggctgcagtgcgccacgattgtgcctgcgaatagccaccacactccagcctgggcaacatagcaagaccttgtctctaaaaagaaacaaagaaaacagaaaaaaagaaggagggttattctgggttagcagaggggatatagaattgacacaagagctggctgggcacggtggctcacgcctgtaatcccagcattttgggagaccaaggcgggtggatcacgaggtcaggagttcgagaccagcccggccaggatggtgaaaccccatctctactaaaaatacaaaaattagccagacgtggtggcgggtgcctgtagtcacagctactcaggaggctgaggcaggagaatcgcttgaacccaggaggcagaggttgcagtgagccaagatcacgccactgcactccagcctgggtgacagagcgagactccatctcaagagagaaaaaaaaaaagtccagaggagttttcttgctttggggtgttgtagaaatgatcttggagcttagccccaaaggacaaacagaatttctcttgtctctgggcaagttgtaggctcatgtgacaggtcaggacagtgtagggctggcataccgctcgctcacgttcacatgcttgcagagaacgtacacagacgaggtgactgaagcctggtctgcaggtcaggcaggtcatcctgatgccagcttgtactgtcaaagagtcacctaactgcaaacggaatttttgtaaagcagatcacattgttaatacctcaggtggctcaaaccttgaacgcgttggcaaacaaaaaacaatccagaaaggtcaattttcacaaaggtcagtgtgcacatgaatctacttgttaaaatgtacattttgattcagtagacctaggatggggctcaggactctgcactttgatcaagactccttggtacgcaaagtgtggcccatgggccagttgcatcaccatcctctgggagcttgttagaaatgaagaatctcaggttccaagtcccacctcagactacagaatccggcgttgcattttaacaagattctctgggaagtcttatacatattaaagttggagaaacagaaaccaaggcgaggtggtccttggttaagtctgcactgtcactgcccaagggagtcattcgngattacagccccagctggcatgcctgtgggcttgatccaggcccacctgggtcatccatgggctaggatcccatggatgggcacatgatccaggagtctgaactcctcccaaagccattacggtggggaggggagatcgccatacgtataacccagtccctttggccaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtata

SEQ ID NO: 455218 - DNA, 5158 bp, Homo sapiens
aacccggtcagatggagtccaggccaggaatgagacaagtattcaggagcaatttgggagatgggcgtgtgcgccagagagacagaggagtgccaggcaacctgggtgctggcctgggtaactggaggacgatggatcttttgctgagctgatgggctcggtgggaggaggaggctgggtggggggcaaggtggtggatggagtctggtcatgtggggccagtggtgctggtgggtcctccaaggggagattcccagctagctggaagtcaaactctcgagcccaagagtttgagaccagcctgagcaacatagcaagaccctgtctctacaaaaaagctaagatattagccaggcctggtggcatacgcctagagtcctagctactcaagaggctgaggtgggaagactgcctgagcctgagaggttgaggctgccgtgagctgtgatggcaccaccgcactccagtctaggtgacagagagagaccctgtctcaaaaaaaaaaaaaaaaaaaagagagagagagacaccagtcactgggctggggccactggggcccaccctactccaatatgacctcaccaaatgaggccacgttcacaggtaccaggtgttgggagctgaacatatctttctgggagacacaacttaagctatcacagaaggggaggcctggctatgattatggctggagggctccatgtagtcgagaggagagtgtcccaacaatgaagagactcggtcatgtcaataggtgaaggtgtagagcttccagcagaggtggccagggtgaagctcagcggcaaagggggcaacagcgcagcaagttcctgaggaggcagaggaaggccagggctcgggggcaggggcagcctccgacagcctgagcaccagaaaaaggaggacaagccactggagggcagtttgtgagtggcaaggagtttgtgggtggcagggagttctcaatgggtggctaagcaagaaggcaggtagctgctgagaggggtggggggctgggatgggcctgaagggaagagaagagaggtgaagaaggccccaagagcgggggcggattagggacctagagaaggttgctaggcagtgctgggggccactgagtttggaaaggtggatttgagcggcaagagtctttgtggtcatgtggcggaatctagagcccccagcagcctaggagaaggagcagggaagtccagtcaatggaaacgtggcatttcttcccgccatatgtcaggaggtaagaaggcaggcaggtgaggctggtggtgagagcgtcatcgatagggcgtgcagcagggtccatggtggatagagaacgaggtgaaggcagagtggagccaggaggtcgtggtcttgaggcagtactgggttgaccctccctggcccaagaggttggagggggtggaggtttcagaggccaggggtgcagtggagactgcgggtaaaagcaaagggcagcagaggagggagcagccatgggggcagcactgcccacctcactcctctctcctccccacagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggtcagctggagcagggcccaggggaaaggctggccctgggcagcttgcaagaggctcgcagccaagtccacccactactgtctacctgcaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaggcttggcacagggctgggtccctgcctccagggctctgggtgcccaggcatggccagggctcattggactctaccctgacaccacctccacgctgctcaggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccattcggatgttggagcggttcc

SEQ ID NO: 455219 - DNA, 879 bp, Homo sapiens
atgagctcggtacctgataaaggttgtggcaggctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtata

SEQ ID NO: 455220 - DNA, 528 bp, Homo sapiens
cagtccagcctgggcaacacagtgaggcaccatctctaaaataaataatactagcaataataataagaagaagaaaaagaagtagtaggagaagaaacccagggcaggggacagaggatgctgcctggggaggccggtgcagtggcactgagggtggagatggatcttgtcaggcagaggacacagggaggcaggggctgtgcattccaggccaaggcacagcacaggcccagcaaggagttgtgagaaggaatggtgggcagcgtggaatggctgcaatggatgagaatggatggaaggtaggaccctgtgagcaggaggtcaggggagggagcaggtgtgccactgacactctttctgcctgcacaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctac

SEQ ID NO: 455221 - DNA, 1690 bp, Homo sapiens
ctcggccctccgagggtgtggagcgcccgggaaacgggaccccaagaatccaactgctcccaccctgcgcggccaggagcggggctggcgatactggggacactgtccaatccgggcagggggcgaggccgggggaccgggcgggcctggggagcaggcacgtgtggagggcggacccgccgggggtcgaggcctgcctctccgagagctcctggcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgttttt

SEQ ID NO: 455222 - DNA, 1022 bp, Homo sapiens
  misc_feature (940)..(941): n is a, c, g, or t
  misc_feature (950)..(950): n is a, c, g, or t
  misc_feature (954)..(954): n is a, c, g, or t
ctcggccctccgagggtgtggagcgcccgggaaacgggaccccaagaatccaactgctcccaccctgcgcggccaggagcggggctggcgatactggggacactgtccaatccgggcagggggcgaggccgggggaccgggcgggcctggggagcaggcacgtgtggagggcggacccgccgggggtcgaggcctgcctctccgagagctcctggcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctnngggagggangaangaagtatctcgccattgcttcagtgagcacgatcccatgatccttatctcaatagcgcagagaatatt

SEQ ID NO: 455223 - DNA, 581 bp, Homo sapiens
tggaaacagggtgggaggataaactggaattctatgttgggagcagtttacacttatttatttgggagcagtagatgacgtgatgatgacaacgatgatgggagtgatgtgactggagctgcactttcagaagagtaatgtaatagtgacgtgtaggatgaacagtggagaggaactggaggctggacgaccaggtaggaagctacctggaaaattccagctggaaaataaagcaggactgagctaggtggggcagggttgcctgaaaagggaagctggagacttcagacatttcacatcacttcccaattgcatctttatccccggcctccttcctgagcttgagactctcatttcacattgctttttagatgtttcattacagatattctactatacccttaatgaactgaaccagaactcattttcccttcaaaccagctcttcttccggacttgcctgtttctgttaatattgctgttgttcctcctacacctaaagaagcagaaccctggaaatcatctccaatttccactttgctcttgtctccaatatttacttagtaacgcctgcctgtgtct

SEQ ID NO: 455224 - DNA, 2328 bp, Homo sapiens
ctcggccctccgagggtgtggagcgcccgggaaacgggaccccaagaatccaactgctcccaccctgcgcggccaggagcggggctggcgatactggggacactgtccaatccgggcagggggcgaggccgggggaccgggcgggcctggggagcaggcacgtgtggagggcggacccgccgggggtcgaggcctgcctctccgagagctcctggcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtatacctctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaaaaaaaaaa

SEQ ID NO: 455225 - DNA, 1988 bp, Homo sapiens
ggccagagtacagagggaccggaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaaaaaaaaaa

SEQ ID NO: 455226 - DNA, 2505 bp, Homo sapiens
ctcggccctccgagggtgtggagcgcccgggaaacgggaccccaagaatccaactgctcccaccctgcgcggccaggagcggggctggcgatactggggacactgtccaatccgggcagggggcgaggccgggggaccgggcgggcctggggagcaggcacgtgtggagggcggacccgccgggggtcgaggcctgcctctccgagagctcctggcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcgcacaaacaacgaggaaacagaagattcaccaaacatttatgaacagccagctgttataaagacaagggaccaatctgaaaaatcagaataaagtctccttgttaaagctgctgcaagaaacaggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaaaaaaaaaa

SEQ ID NO: 455227 - DNA, 2326 bp, Homo sapiens
ctcggccctccgagggtgtggagcgcccgggaaacgggaccccaagaatccaactgctcccaccctgcgcggccaggagcggggctggcgatactggggacactgtccaatccgggcagggggcgaggccgggggaccgggcgggcctggggagcaggcacgtgtggagggcggacccgccgggggtcgaggcctgcctctccgagagctcctggcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgatttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaaaaaaaaaa

SEQ ID NO: 455228 - DNA, 1696 bp, Homo sapiens
ctcgtgccgattcggcacgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaaaaaaaaaa

SEQ ID NO: 455229 - DNA, 2687 bp, Homo sapiens
ctcggccctccgagggtgtggagcgcccgggaaacgggaccccaagaatccaactgctcccaccctgcgcggccaggagcggggctggcgatactggggacactgtccaatccgggcagggggcgaggccgggggaccgggcgggcctggggagcaggcacgtgtggagggcggacccgccgggggtcgaggcctgcctctccgagagctcctggcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatataaaaaaaaaaaaaaaaaaaaaaaaggggggcgcacggccaaccaaagatacccccacaaggggccaaagaataaagcggaaacccaggcaacgaggagaacacagcggcggcccacacaaacgacgcagacgcatcattcaaacagaaaagagcacaggggcagagagctaaccaccacacgccgacgcaacacgggcgaacaacacgtgccacacccggcagcaactctctcgacacacacggaaccccccacacgcaccgagcacgacccggacacaccatcccgcgagcaccaacaccaccccaaacagcacacaccacacaccgaccccacacaggcaaccaaacacaaccaccacaaacgcgcacaaccacgccgcacaaacgcccacgcctgcacacaaacgacccgccgcgcctacgcaccaagctcgaggcaccaccagcagaccatatcgacaacacagccaaaacactgactccacaccacccgcgaccacccaccggacatacaacacacatacccaccacacacaccgcacgcaacaacaccaccaccgaccacaccctgaagagaacaaacaagcacgcacgcggcgaggatagacacgaggaagacgcaacacaacacaaagaaccgacaaaaaaggggcacacaagacagacaaacaagcacagaaacaagcgaagggggcgacaagacaaggcacatgccgcgaagacaaacacatgagagcgaatacacacgagaggaagaagcacaggtagagcaacaagaccagagacaagacgcaagaagccagcacaacacagacgagtgacacgatacaaaccacgagcaagtacgacacaaaaggacgagagcaggcaacgaccaggaatggtaaggacggacagcgaaacaaccaaccagaggctcagcagagatcaaggacgaaacgagcagcaacgacgaagaccaaagacgagcactcaagatgagagtagagagagagaagtgagaaccagcagacaggacagcacgaaacgagaggacacaacacacaaacgcacagacaaagagagccgacactaaacgggatccgcagagcgacgacgacagcatcgacacgaagaaaggacga

SEQ ID NO: 455230 - DNA, 1722 bp, Homo sapiens
cttagaggatcccaatctctcgagcgagaggaggaggagccggctcgaagaattctgttgggtggtgactctgttcttgactagagtcatggcatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcaggggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaaaaaaaaaa

SEQ ID NO: 455231 - DNA, 1635 bp, Homo sapiens
  misc_feature (101)..(101): n is a, c, g, or t
aaagagatcctgggaccataacgcaaggctacgcagggagcaagtatgggtaaggtggacctatgagaatcgatgacatgtctgtctcttagagcaagatncgttgtgcatagtgtaccaaggtggagttgcgtaggtcgtcatcctagattaagaatagagtggggcaggggagtgaacggaagatgttatctgggaacagcattgctacgtactggtggaggtatctaggaatggtccactagagatgacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaaaaaaaaaa

SEQ ID NO: 455232 - DNA, 1358 bp, Homo sapiens
gtgaccacaggacataatacttttttttttttttttttgagatagagtctcgctctgttgcccaggctggagtgcagtggcgtgatctcgtctcactgcaacctccgcctcctgggttcaagcaattctcctgtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaaaaaaaaaa

SEQ ID NO: 455233 - DNA, 1111 bp, Homo sapiens
ctcggccctccgagggtgtggagcgcccgggaaacgggaccccaagaatccaactgctcccaccctgcgcggccaggagcggggctggcgatactggggacactgtccaatccgggcagggggcgaggccgggggaccgggcgggcctggggagcaggcacgtgtggagggcggacccgccgggggtcgaggcctgcctctccgagagctcctggcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgcttccgggggatcctctag

SEQ ID NO: 455234 - DNA, 1038 bp, Homo sapiens
  misc_feature (1020)..(1020): n is a, c, g, or t
ctcggccctccgagggtgtggagcgcccgggaaacgggaccccaagaatccaactgctcccaccctgcgcggccaggagcggggctggcgatactggggacactgtccaatccgggcagggggcgaggccgggggaccgggcgggcctggggagcaggcacgtgtggagggcggacccgccgggggtcgaggcctgcctctccgagagctcctggcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccagacctgtatgagctgcgagagattnggatcctctaggtaccca

SEQ ID NO: 455235 - DNA, 1370 bp, Homo sapiens
ctcggccctccgagggtgtggagcgcccgggaaacgggaccccaagaatccaactgctcccaccctgcgcggccaggagcggggctggcgatactggggacactgtccaatccgggcagggggcgaggccgggggaccgggcgggcctggggagcaggcacgtgtggagggcggacccgccgggggtcgaggcctgcctctccgagagctcctggcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcgtacgtgacatccgcagtggccctggctgaggtttcgctgtgattagagaatgagggtagcagcgggttgttgtttgctgattagacttttcacagaacgctgagcatgagggatcctcggtgccaagctctgcttcgagggagatccctgtttagccaaatggcggtctgttggctccttaagatttctcagaatatggacggagccttgaagatgacattcgctctgacacatcgttcatgttccagcgagtgctggtgtctctgtcagcttgtgagtgactgcttctgatggggggcgggttttatcgaaatgtccactctatcccctttgccagcctttctcatcctttcagcccctgacatgtggatattccccaggtagtgttctcagacccctctgttcctttatcttatttctccttcagagactctggctaatcctgcctgcccattttttctactttaatttgatatttacaagtacctaacacctgccaggtccccctgt

SEQ ID NO: 455236 - DNA, 1639 bp, Homo sapiens
ctcggccctccgagggtgtggagcgcccgggaaacgggaccccaagaatccaactgctcccaccctgcgcggccaggagcggggctggcgatactggggacactgtccaatccgggcagggggcgaggccgggggaccgggcgggcctggggagcaggcacgtgtggagggcggacccgccgggggtcgaggcctgcctctccgagagctcctggcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcgtacgtgacatccgcagtggccctggctgaggtttcgctgtgattagagaatgagggtagcagcgggttgttgtttgctgattagacttttcacagaacgctgagcatgagggatcctcggtgccaagctctgcttcgagggagatccctgtttagccaaatggcggtctgttggctccttaagatttctcagaatatggacggagccttgaagatgacattcgctctgacacatcgttcatgttccagcgagtgctggtgtctctgtcagctatgacgtgatgatgacaacgatgatgggagtgatgtgactggagctgcactttcagaagagtaatgtaatagtgacgtgtaggatgaacagtggagaggaactggaggctggacgaccaggtaggaagctacctggaaaattccagctggaaaataaagcaggactgagctaggtggggcagggttgcctgaaaagggaagctggagacttcagacatttcacatcacttcccaattgcatctttatccccggcctccttcctgagcttgagactctcatttcacattgctttttagatgtttcattacagatattctactatacccttaatgaactgaaccagaactcattttcccttcaaaccagctcttcttccggacttgcctgtttctgttaatattgctgttgttcctcctacacctaaagaagcagaaccctggaaatcatctccaatttccactttgctcttgtctccaatatttacttagtaacgcctgcctgtgtct

SEQ ID NO: 455237 - DNA, 434 bp, Homo sapiens
atttaaagctaagaaaaatccagccaagcttgaaaaagttggcttagatgactttgaactgtgtgtttcattttaaaatctatttatctaactttgcttccctatcgaacagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgttttt

SEQ ID NO: 455238 - DNA, 392 bp, Homo sapiens
tgaggcaggagaattgcatgaacccaggaggcagaggttgcagtgagctgagatggtgccactgcactccagactccatccagcctgggcaacagaatgagactccatctcaaaagaaacaaaacaaaaacaggaatatcgtgtgacaggataagctgatcttgaccattttaccagagtttagtttttgaaaaactgtgtgtggggtgaaaaaacctcatgataagctgcttccataagcaggctggtcttgaggggacagattgctctggagtgtgacagggcattgggcaagactcttaattctgaagtagctaatttcactctcttgctagaatatggacggagccttgaagatgacattcgctctgacacatcgttcatgttccagc

SEQ ID NO: 455239 - DNA, 2382 bp, Homo sapiens
ctcggccctccgagggtgtggagcgcccgggaaacgggaccccaagaatccaactgctcccaccctgcgcggccaggagcggggctggcgatactggggacactgtccaatccgggcagggggcgaggccgggggaccgggcgggcctggggagcaggcacgtgtggagggcggacccgccgggggtcgaggcctgcctctccgagagctcctggcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaaaaaaaaaa

SEQ ID NO: 455240 - DNA, 826 bp, Homo sapiens
  misc_feature (729)..(729): n is a, c, g, or t
  misc_feature (739)..(739): n is a, c, g, or t
  misc_feature (748)..(748): n is a, c, g, or t
catacgctagtagaggccgggagtaaatcggacgaggcgcagcccggctctaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtngatgaatacnaaaggatancacgttcgcgagggataacacgttcgcgagagatacaccctcgcgagggatacacgtcgccgagggattacacgttcg

SEQ ID NO: 455241 - DNA, 2038 bp, Homo sapiens
gtggatgctgaggtactctagaggattccaaatcctctcgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaaaaaaaaaa

SEQ ID NO: 455242 - DNA, 2104 bp, Homo sapiens
tcaaagggggaacctcttctgatctgctgtaacattcagttcagaatctgtgtccagcttgagtacaagtattggtacttaacctaacaaaacaataggaatcctttctgtagtgtgtatctccaaacagaagaacagaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaaaaaaaaaa

SEQ ID NO: 455243 - DNA, 2329 bp, Homo sapiens
ctcggccctccgagggtgtggagcgcccgggaaacgggaccccaagaatccaactgctcccaccctgcgcggccaggagcggggctggcgatactggggacactgtccaatccgggcagggggcgaggccgggggaccgggcgggcctggggagcaggcacgtgtggagggcggacccgccgggggtcgaggcctgcctctccgagagctcctggcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaatctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaaaaaaaaaa

SEQ ID NO: 455244 - DNA, 2320 bp, Homo sapiens
ctcggccctccgagggtgtggagcgcccgggaaacgggaccccaagaatccaactgctcccaccctgcgcggccaggagcggggctggcgatactggggacactgtccaatccgggcagggggcgaggccgggggaccgggcgggcctggggagcaggcacgtgtggagggcggacccgccgggggtcgaggcctgcctctccgagagctcctggcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgaggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaaaaaaaaaa

SEQ ID NO: 455245 - DNA, 2097 bp, Homo sapiens
ctcggccctccgagggtgtggagcgcccgggaaacgggaccccaagaatccaactgctcccaccctgcgcggccaggagcggggctggcgatactggggacactgtccaatccgggcagggggcgaggccgggggaccgggcgggcctggggagcaggcacgtgtggagggcggacccgccgggggtcgaggcctgcctctccgagagctcctggcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcaggggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaaaaaaaaaa

SEQ ID NO: 455246 - DNA, 1956 bp, Homo sapiens
aagattcaaggtcttgctatgtttcccaggccagctcttcacaggtgccatcttagctcactgccttgaactcctggcctcaagacatcctcccacctcagcctcgagtagctggaactacatgcacatcccgacccccttttggcagaggttgatcaatgtagatttgccagttaggaaggcatgagtcagctgggaagacacaggagagtggggtggtgggggaggccaggagatagtggagggagctgtccttgggaagcttctcctgctattggcagaggcactcatgcaacgttaggggccacactgaggctcagccctctaggcacacatcagagccattgtaataatgcgagcgcatttagaggacgtctgtcctccctccctgggtctgaagctccaattcttgtggtattttgtctcattactctagacctgctatcttaatggtgtccccagatcttcatgtatactctcgaattattttttatttgtttttctcatcctcagggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaaaaaaaaaa

SEQ ID NO: 455247 - DNA, 1567 bp, Homo sapiens
ctcggccctccgagggtgtggagcgcccgggaaacgggaccccaagaatccaactgctcccaccctgcgcggccaggagcggggctggcgatactggggacactgtccaatccgggcagggggcgaggccgggggaccgggcgggcctggggagcaggcacgtgtggagggcggacccgccgggggtcgaggcctgcctctccgagagctcctggcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgttttt

SEQ ID NO: 455248 - DNA, 1191 bp, Homo sapiens
  misc_feature (1094)..(1094): n is a, c, g, or t
  misc_feature (1104)..(1104): n is a, c, g, or t
  misc_feature (1113)..(1113): n is a, c, g, or t
ctcggccctccgagggtgtggagcgcccgggaaacgggaccccaagaatccaactgctcccaccctgcgcggccaggagcggggctggcgatactggggacactgtccaatccgggcagggggcgaggccgggggaccgggcgggcctggggagcaggcacgtgtggagggcggacccgccgggggtcgaggcctgcctctccgagagctcctggcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtngatgaatacnaaaggatancacgttcgcgagggataacacgttcgcgagagatacaccctcgcgagggatacacgtcgccgagggattacacgttcg

SEQ ID NO: 455249 - DNA, 1018 bp, Homo sapiens
ctcggccctccgagggtgtggagcgcccgggaaacgggaccccaagaatccaactgctcccaccctgcgcggccaggagcggggctggcgatactggggacactgtccaatccgggcagggggcgaggccgggggaccgggcgggcctggggagcaggcacgtgtggagggcggacccgccgggggtcgaggcctgcctctccgagagctcctggcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagcttctgatgggagggaccgaatggaaatcatctgcccgatgctctcactgtatcaccacgatgtaacacgacccccaagtg

SEQ ID NO: 455250 - DNA, 921 bp, Homo sapiens
ctcggccctccgagggtgtggagcgcccgggaaacgggaccccaagaatccaactgctcccaccctgcgcggccaggagcggggctggcgatactggggacactgtccaatccgggcagggggcgaggccgggggaccgggcgggcctggggagcaggcacgtgtggagggcggacccgccgggggtcgaggcctgcctctccgagagctcctggcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcgcacaaacaacgaggaaacagaagattcaccaaacatttatgaacagccagctgttataaagacaagggaccaatctgaaaaatcagaataaagtctccttgttaaagctgctgcaagaaacaggcaagcaaaacttagaacatttttaatttgtaatttttgcttaaagttttggtaagatgttgtatcatggtaatttgtcagcagttctaaaagggaaccatttgtgttttgaaacaattcaaacttgtctgttaattcaccaatttggcattttgcagagtttaaattggctgttactgcattcactgtgttttaaaatctggaactatgttttgcacttctaagccatctttcctgaa

SEQ ID NO: 455251 - DNA, 2701 bp, Homo sapiens
gccctttcctggcggctgggtctttaacaccgcccagcgcacatgtcgggggaggcctggcagctgcagctgggagcgcacagacggctgccccgcctgagcgaggcgggcgccgccgcgatgctgcgaggcggacggcgcgggcagcttggctggcacagctgggctgcggggccgggcagcctgctggcttggctgatactggcatctgcgggcgccgcaccctgccccgatgcctgctgcccccacggctcctcgggactgcgatgcacccgggatggggccctggatagcctccaccacctgcccggcgcagagaacctgactgagctctacatcgagaaccagcagcatctgcagcatctggagctccgtgatctgaggggcctgggggagctgagaaacctcaccatcgtgaagagtggtctccgtttcgtggcgccagatgccttccatttcactcctcggctcagtcgcctgaatctctccttcaacgctctggagtctctctcctggaaaactgtgcagggcctctccttacaggaactggtcctgtcggggaaccctctgcactgttcttgtgccctgcgctggctacagcgctgggaggaggagggactgggcggagtgcctgaacagaagctgcagtgtcatgggcaagggcccctggcccacatgcccaatgccagctgtggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatgaaatctgggggtctgccatccctggggctgaccctggccaatgtcaccagtgacctcaacaggaagaacgtgacgtgctgggcagagaacgatgtgggccgggcagaggtctctgttcaggtcaacgtctccttcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccaacgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctagggggccggcccaggggctgggagtggttagccggaatactggggcctgccctcagcatcccccatagctcccagcagccccagggtgatctcgaagtatctaattcgccctcagcatgtgggaagggacaggtgggggctgggagtagaggatgttcctgcttctctaggcaaggtcccgtcatagcaattatatttattatcccttg

SEQ ID NO: 455252 - DNA, 1732 bp, Homo sapiens
ctggccccaccgacatggcggcggtgttgcagcaagtcctggagcgcacggagctgaacaagctgcccaagtctgtccagaacaaacttgaaaagttccttgctgatcggcaatccgagatcgatggcctgaaggggcggcatgagaaatttaaggtggagagcgaacaacagtattttgaaatagaaaagaggttgtcccacagtcaggagagacttgtgaatgaaacccgagagtgtcaaagcttgcggcttgagctagagaaactcaacaatcaactgaaggcactaactgagaaaaacaaagaacttgaaattgctcaggatcgcaatattgccattcagagccaatttacaagaacaaaggaagaattagaagctgagaaaagagacttaattagaaccaatgagagactatctcaagaacttgaatacttaacagaggatgttaaacgtctgaatgaaaaacttaaagaaagcaatacaacaaagggtgaacttcagttaaaattggatgaacttcaagcttctgatgtttctgttaagtatcgagaaaaacgcttggagcaagaaaaggaattgctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccaacgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctagggggccggcccaggggctgggagtggttagccggaatactggggcctgccctcagcatcccccatagctcccagcagccccagggtgatctcgaagtatctaattcgccctcagcatgtgggaagggacaggtgggggctgggagtagaggatgttcctgcttctctaggcaaggtcccgtcatagcaattatatttattatcccttg

SEQ ID NO: 455253 - DNA, 1558 bp, Homo sapiens
tttcctttctctctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattgacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccaacgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctagggggccggcccaggggctgggagtggttagccggaatactggggcctgccctcagcatcccccatagctcccagcagccccagggtgatctcgaagtatctaattcgccctcagcatgtgggaagggacaggtgggggctgggagtagaggatgttcctgcttctctaggcaaggtcccgtcatagcaattatatttattatcccttg

SEQ ID NO: 455254 - DNA, 2000 bp, Homo sapiens
aacatcctggagtccaccatgaacggacagttggatctaagtgggaagctaatcgtcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccaacgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctagggggccggcccaggggctgggagtggttagccggaatactggggcctgccctcagcatcccccatagctcccagcagccccagggtgatctcgaagtatctaattcgccctcagcatgtgggaagggacaggtgggggctgggagtagaggatgttcctgcttctctaggcaaggtcccgtcatagcaattatatttattatcccttg

SEQ ID NO: 455255 - DNA, 439 bp, Homo sapiens
gtggtgtaagggggctggggaagagacctacctgcctgagggagagggcactgagcaagcactgaaaaggcctggggaatgggcactggcaaaggctgggggaaactgcctggggtgacatcgcctgggctccaggtcattgaggagggtgggggaaggagcagccccgcagtagagttctggggccactcccagctctaacaccccttggccctcgggcgtcctgggtggccaggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatggtgagaagaccttcgctggcagcccccaagaggtccaggcagagcacaggggacaaagatg

SEQ ID NO: 455256 - DNA, 571 bp, Homo sapiens
ccagctgttccattagcccaaaaaattgagatatggatgtcgttccttatctctagctcttctagtcatcttttcttgatttattatgctaacctttgttttaagccacattccctcttactatgtccttacacagttgagagggaagtcgtggagatgctataccagagagtgggtgtgagaggggtgggaaaatgaattgaggaccagtgccaacatgcatttctgcctcctccctcccgggcccttgtcctgactgcagtgcacttctgcatcctatctgagattgtgaaaatggccaagggtgtgatactggctgagaggagctggctcattgagggcagggccacagggtgagtctgcactggaagggagttgatagcctcttgctcttctgtccccagctcttggagcagtcggagtggcagccaacaaacgtggatgggaaggggtacctactcaatgaacctggagtccagcccacctctgtctatggagactttagctgtaaggaggagccagaaattgacagcccagggggtaagaaggccctggatccttatcttatggc

SEQ ID NO: 455257 - DNA, 757 bp, Homo sapiens
ggactgcccctggtggactcctccaatgactcgtaagtaacattctttaaattatatatgcttggattttgtcatgcacctccctggaccccgtgtgtgtcgtcgtgtgtgtgtgtcagagagacagagagacagagaaagggcagggggatctggtgggctggaactggaactgcagggtgagtgtggctgactgccagccaacctctctgctttccccatccacagctacaacagatgaggatgaggaagggaaattacctgaggacatcatgaaggtaaagccccttcctacctgggcactcttgaagtgaccgtttctcagtgaggagagagaaccagtgaagcttccaaatcagaggatgggtagctgctgttgtcacctggctgcttgcattgtcccacaagtgccacattcacgtggcttgactggtgggaaagccaccatgggaagggaaggcaggtgggaggcctggcctctgacaggccgtcctgaagcaagccttggggcatcagacagctctgtgagtcaggcactatcagcgatgggtccctggcctgcatcctctgccccaacatgccccagccctgctagttcgggaaatgcacatcaggcttcaataatcagcctttaggatccgttaatatgatgatggctttatagaaaaagttagcaaattatcctccaggtttttttttctgcttcagttttgaaagtgaatatagtttttgcagccgggggcagtggctcatgcct

SEQ ID NO: 455258 - DNA, 2129 bp, Homo sapiens
  misc_feature (30)..(30): n is a, c, g, or t
agaacaatgacgtgctgaggttagcgaggnccgcggcgtggtttaaatttcggcgacggaggctgaggccttagtcgaggcaagacgtgcgcccgagccccgccgaagcgaggccacccggagccgtgcccagtccacgccggccgtgcccggcggccttaagaacccggcaacctctgccttcttccctcttccacttggagtcgcgctccgcgcgccctcactgcagcccctgcgtcgccgggaccctcgcgcgcgaccgccgaatcgctcctgcagcagagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctccccgactggcacatcccagtggaagttgtgccggacagcaccagtgatctgtacaacttccaggtgtcacccatgccctccacctctgaagctacaacagatgaggatgaggaagggaaattacctgaggacatcatgaagctcttggagcagtcggagtggcagccaacaaacgtggatgggaaggggtacctactcaatgaacctggagtccagcccacctctgtctatggagactttagctgtaaggaggagccagaaattgacagcccagggggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataggacgtgtgtaaatatgtacatttgtctttttataaaaagtaaattgtt

SEQ ID NO: 455259 - DNA, 2531 bp, Homo sapiens
  misc_feature (30)..(30): n is a, c, g, or t
agaacaatgacgtgctgaggttagcgaggnccgcggcgtggtttaaatttcggcgacggaggctgaggccttagtcgaggcaagacgtgcgcccgagccccgccgaagcgaggccacccggagccgtgcccagtccacgccggccgtgcccggcggccttaagaacccggcaacctctgccttcttccctcttccacttggagtcgcgctccgcgcgccctcactgcagcccctgcgtcgccgggaccctcgcgcgcgaccgccgaatcgctcctgcagcagagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctccccgactggcacatcccagtggaagttgtgccggacagcaccagtgatctgtacaacttccaggtgtcacccatgccctccacctctgaagctacaacagatgaggatgaggaagggaaattacctgaggacatcatgaagctcttggagcagtcggagtggcagccaacaaacgtggatgggaaggggtacctactcaatgaacctggagtccagcccacctctgtctatggagactttagctgtaaggaggagccagaaattgacagcccagggggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataggacgtgtgtaaatatgtacatttgtctttttataaaaagtaaattgtttataaggggtgtggcctttttagagagaaatttaacttgtagatgattttactttttatggaaacactgatggacttattattggcatcccgcctgaacttgactttggggtgaacagggacatgcatctgttataaaatcctttcggacaggcgcggtggctcacacctgtaatcccagcactttgggaggccgagatgggtggatcacctgaggtcaggagtttgagaccagcctggtgaaactccatttctactaaaaatgcaaaaattagctgggcgtggttgcgggtgcttgtaatcccagctactcaggaggctgaggcaagagaatcgcttgaacctgggaggtggaggttgcagtgagccgagaacatgccattgcactccagcccgggcacca

SEQ ID NO: 455260 - DNA, 2007 bp, Homo sapiens
agagcagttttattccagcgcagctcccctccgcactgagtgtagtacctagcagctggctgaggtgaggggagggtaactaagtgacctcgggtggggcaggtcactgcccaggtactgttcaacagattccagactggagcctctgtgttctctttacagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctccccgactggcacatcccagtggaagttgtgccggacagcaccagtgatctgtacaacttccaggtgtcacccatgccctccacctctgaagctacaacagatgaggatgaggaagggaaattacctgaggacatcatgaagctcttggagcagtcggagtggcagccaacaaacgtggatgggaaggggtacctactcaatgaacctggagtccagcccacctctgtctatggagactttagctgtaaggaggagccagaaattgacagcccagggggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataggacgtgtgtaaatatgtacatttgtctttttataaaaagtaaattgtt

SEQ ID NO: 455261 - DNA, 2148 bp, Homo sapiens
  misc_feature (148)..(148): n is a, c, g, or t
  misc_feature (170)..(170): n is a, c, g, or t
  misc_feature (219)..(219): n is a, c, g, or t
ccatatgctaggtgggctgggttaatcggccgaggccttagtcgaggcaagacgtgcgcccgagccccgccgaagcgaggccacccggagccgtgcccagtccacgccggccgtgcccggcggccttaagaacccggacatagccccnttccttgggcccccttttttcntttttcccccttccttttccccaaccggtccggggggaaggtcggcgcntcccggccgggcgggcccttcaactgcagcccctgcgtcgccgggaccctcgcgcgcgaccgccgaatcgctcctgcagcagagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctccccgactggcacatcccagtggaagttgtgccggacagcaccagtgatctgtacaacttccaggtgtcacccatgccctccacctctgaagctacaacagatgaggatgaggaagggaaattacctgaggacatcatgaagctcttggagcagtcggagtggcagccaacaaacgtggatgggaaggggtacctactcaatgaacctggagtccagcccacctctgtctatggagactttagctgtaaggaggagccagaaattgacagcccagggggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataggacgtgtgtaaatatgtacatttgtctttttataaaaagtaaattgtt

SEQ ID NO: 455262 - DNA, 2015 bp, Homo sapiens
ccatatgctaggtgggctgggttaatcggccgaggccttagtcgaggcaagacgtgcgcccgagccccgccgaagcgaggccacccggagccgtgcccagtccacgccggccgtgcccggcggccttaagaacccggcaacctctgccttcttccctcttccacttggagtcgcgctccgcgcgccctcactgcagcccctgcgtcgccgggaccctcgcgcgcgaccgccgaatcgctcctgcagcagagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctccccgactggcacatcccagtggaagttgtgccggacagcaccagtgatctgtacaacttccaggtgtcacccatgccctccacctctgaagctacaacagatgaggatgaggaagggaaattacctgaggacatcatgaagctcttggagcagtcggagtggcagccaacaaacgtggatgggaaggggtacctactcaatgaacctggagtccagcccacctctgtctatggagactttagctgtaaggaggagccagaaattgacagcccagggggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataggacgtgtgtaaatatgtacatttgtctttttataaaaagtaaattgtt

SEQ ID NO: 455263 - DNA, 1943 bp, Homo sapiens
  misc_feature (30)..(30): n is a, c, g, or t
agaacaatgacgtgctgaggttagcgaggnccgcggcgtggtttaaatttcggcgacggaggctgaggccttagtcgaggcaagacgtgcgcccgagccccgccgaagcgaggccacccggagccgtgcccagtccacgccggccgtgcccggcggccttaagaacccggcaacctctgccttcttccctcttccacttggagtcgcgctccgcgcgccctcactgcagcccctgcgtcgccgggaccctcgcgcgcgaccgccgaatcgctcctgcagcagagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctccccgactggcacatcccagtggaagttgtgccggacagcaccagtgatctgtacaacttccaggtgtcacccatgccctccacctctgaaggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataggacgtgtgtaaatatgtacatttgtctttttataaaaagtaaattgtt

SEQ ID NO: 455264 - DNA, 1527 bp, Homo sapiens
ccagctgttccattagcccaaaaaattgagatatggatgtcgttccttatctctagctcttctagtcatcttttcttgatttattatgctaacctttgttttaagccacattccctcttactatgtccttacacagttgagagggaagtcgtggagatgctataccagagagtgggtgtgagaggggtgggaaaatgaattgaggaccagtgccaacatgcatttctgcctcctccctcccgggcccttgtcctgactgcagtgcacttctgcatcctatctgagattgtgaaaatggccaagggtgtgatactggctgagaggagctggctcattgagggcagggccacagggtgagtctgcactggaagggagttgatagcctcttgctcttctgtccccagctcttggagcagtcggagtggcagccaacaaacgtggatgggaaggggtacctactcaatgaacctggagtccagcccacctctgtctatggagactttagctgtaaggaggagccagaaattgacagcccagggggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataggacgtgtgtaaatatgtacatttgtctttttataaaaagtaaattgtt

SEQ ID NO: 455265 - DNA, 1135 bp, Homo sapiens
  misc_feature (30)..(30): n is a, c, g, or t
agaacaatgacgtgctgaggttagcgaggnccgcggcgtggtttaaatttcggcgacggaggctgaggccttagtcgaggcaagacgtgcgcccgagccccgccgaagcgaggccacccggagccgtgcccagtccacgccggccgtgcccggcggccttaagaacccggcaacctctgccttcttccctcttccacttggagtcgcgctccgcgcgccctcactgcagcccctgcgtcgccgggaccctcgcgcgcgaccgccgaatcgctcctgcagcagagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctccccgactggcacatcccagtggaagttgtgccggacagcaccagtgatctgtacaacttccaggtgtcacccatgccctccacctctgaagtcaactttgaagtacaccgatgaggacgacggaagggcaacctggggaatcataaaccaggaaacacagagcagaaacacgggtcggcagggggaccacaagacacgagccaccacactcgcacgaacacagaaaggaaccaatcaaccgaggagaagaaggagaggaaaaaaaaacgc

SEQ ID NO: 455266 - DNA, 987 bp, Homo sapiens
  misc_feature (30)..(30): n is a, c, g, or t
agaacaatgacgtgctgaggttagcgaggnccgcggcgtggtttaaatttcggcgacggaggctgaggccttagtcgaggcaagacgtgcgcccgagccccgccgaagcgaggccacccggagccgtgcccagtccacgccggccgtgcccggcggccttaagaacccggcaacctctgccttcttccctcttccacttggagtcgcgctccgcgcgccctcactgcagcccctgcgtcgccgggaccctcgcgcgcgaccgccgaatcgctcctgcagcagagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctccccgactggcacatcccagtggaagttgtgccggacagcaccagtgatctgtacaacttccaggtgtcacccatgccctccacctctgaagcaccgatgccgctgcgcggggcatcccgggg

SEQ ID NO: 455267 - DNA, 1183 bp, Homo sapiens
cggtaaagcatctggggtactgacacattgtgaattagctacggctgccatgccttaaggtttgcctgaagctgagtggatgtttactgctgtgctgggaagagcagaggccatgtctatggccttcaggggtagggggaagcacacctgatgccaccgtcccctaccctcatacaaccttcttcacatcttctaggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataggacgtgtgtaaatatgtacatttgtctttttataaaaagtaaattgtt

SEQ ID NO: 455268 - DNA, 491 bp, Homo sapiens
tcagcagctccactctgcctgatgaccacagcagctacacagttccaggctacatgcaggacttggaggtggagcaggccctgactccaggtgagctggtccaggtctggcaggagaccccacaggtcagtgggatgactctttctcttggaggcatggtgctggcacatggtggcccattagtgcaggctgcagggttggtcggagggcgctcgatgtcttgcaaactaagaaagcacacaaccttgacctgtggcttctgctgttccccagcactgtcgccatgtgctgtcagcagcactctccccgactggcacatcccagtggaagttgtgccggacagcaccagtgatctgtacaacttccaggtgtcacccatgccctccacctctgaagaggttggtgctcctggggcctggcctgcctgcttgactgtctgggtcctgtgaagggcttcctgagagagaaaagatgatcagaactccacctgg

SEQ ID NO: 455269 - DNA, 2096 bp, Homo sapiens
ccatatgctaggtgggctgggttaatcggccgaggccttagtcgaggcaagacgtgcgcccgagccccgccgaagcgaggccacccggagccgtgcccagtccacgccggccgtgcccggcggccttaagaacccggcaacctctgccttcttccctcttccacttggagtcgcgctccgcgcgccctcactgcagcccctgcgtcgccgggaccctcgcgcgcgaccgccgaatcgctcctgcagcagagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctccccgactggcacatcccagtggaagttgtgccggacagcaccagtgatctgtacaacttccaggtgtcacccatgccctccacctctgaagctacaacagatgaggatgaggaagggaaattacctgaggacatcatgaagctcttggagcagtcggagtggcagccaacaaacgtggatgggaaggggtacctactcaatgaacctggagtccagcccacctctgtctatggagactttagctgtaaggaggagccagaaattgacagcccagggggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataggacgtgtgtaaatatgtacatttgtctttttataaaaagtaaattgtt

SEQ ID NO: 455270 - DNA, 2019 bp, Homo sapiens
  misc_feature (30)..(30): n is a, c, g, or t
agaacaatgacgtgctgaggttagcgaggnccgcggcgtggtttaaatttcggcgacggaggctgaggccttagtcgaggcaagacgtgcgcccgagccccgccgaagcgaggccacccggagccgtgcccagtccacgccggccgtgcccggcggccttaagaacccggcaacctctgccttcttccctcttccacttggagtcgcgctccgcgcgccctcactgcagcccctgcgtcgccgggaccctcgcgcgcgaccgccgaatcgctcctgcagcagagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctccccgactggcacatcccagtggaagttgtgccggacagcaccagtgatctgtacaacttccaggtgtcacccatgccctccacctctgaagctacaacagatgaggatgaggaagggaaattacctgaggacatcatgaagctcttggagcagtcggagtggcagccaacaaacgtggatgggaaggggtacctactcaatgaacctggagtccagcccacctctgtctatggagactttagctgtaaggaggagccagaaattgacagcccagggggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagttggcttggtttcatcagggtgcgggcacaaccttaacaagctaagcggggggtgcccggtataaagagtttacacattgacaaggggatacttgaaaca

SEQ ID NO: 455271 - DNA, 1904 bp, Homo sapiens
ccatatgctaggtgggctgggttaatcggccgaggccttagtcgaggcaagacgtgcgcccgagccccgccgaagcgaggccacccggagccgtgcccagtccacgccggccgtgcccggcggccttaagaacccggcaacctctgccttcttccctcttccacttggagtcgcgctccgcgcgccctcactgcagcccctgcgtcgccgggaccctcgcgcgcgaccgccgaatcgctcctgcagcagaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctccccgactggcacatcccagtggaagttgtgccggacagcaccagtgatctgtacaacttccaggtgtcacccatgccctccacctctgaagctacaacagatgaggatgaggaagggaaattacctgaggacatcatgaagctcttggagcagtcggagtggcagccaacaaacgtggatgggaaggggtacctactcaatgaacctggagtccagcccacctctgtctatggagactttagctgtaaggaggagccagaaattgacagcccagggggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataggacgtgtgtaaatatgtacatttgtctttttataaaaagtaaattgtt

SEQ ID NO: 455272 - DNA, 1973 bp, Homo sapiens
ccatatgctaggtgggctgggttaatcggccgaggccttagtcgaggcaagacgtgcgcccgagccccgccgaagcgaggccacccggagccgtgcccagtccacgccggccgtgcccggcggccttaagaacccggcaacctctgccttcttccctcttccacttggagtcgcgctccgcgcgccctcactgcagcccctgcgtcgccgggaccctcgcgcgcgaccgccgaatcgctcctgcagcagagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagctacaacagatgaggatgaggaagggaaattacctgaggacatcatgaagctcttggagcagtcggagtggcagccaacaaacgtggatgggaaggggtacctactcaatgaacctggagtccagcccacctctgtctatggagactttagctgtaaggaggagccagaaattgacagcccagggggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataggacgtgtgtaaatatgtacatttgtctttttataaaaagtaaattgtt

SEQ ID NO: 455273 - DNA, 1904 bp, Homo sapiens
  misc_feature (30)..(30): n is a, c, g, or t
agaacaatgacgtgctgaggttagcgaggnccgcggcgtggtttaaatttcggcgacggaggctgaggccttagtcgaggcaagacgtgcgcccgagccccgccgaagcgaggccacccggagccgtgcccagtccacgccggccgtgcccggcggccttaagaacccggcaacctctgccttcttccctcttccacttggagtcgcgctccgcgcgccctcactgcagcccctgcgtcgccgggaccctcgcgcgcgaccgccgaatcgctcctgcagcagagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctccccgactggcacatcccagtggaagttgtgccggacagcaccagtgatctgtacaacttccaggtgtcacccatgccctccacctctgaagctacaacagatgaggatgaggaagggaaattacctgaggacatcatgaagctcttggagcagtcggagtggcagccaacaaacgtggatgggaaggggtacctactcaatgaacctggagtccagcccacctctgtctatggagactttagctgtaaggaggagccagaaattgacagcccagggggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataggacgtgtgtaaatatgtacatttgtctttttataaaaagtaaattgtttataaggggtgtggcctttttagagagaaatttaacttgtagatgattttactttttatggaaacactgatggacttattattggcatcccgcctgaacttgactttggggtgaacagggacatgcatctgttataaaatcctttcggacaggcgcggtggctcacacctgtaatcccagcactttgggaggccgagatgggtggatcacctgaggtcaggagtttgagaccagcctggtgaaactccatttctactaaaaatgcaaaaattagctgggcgtggttgcgggtgcttgtaatcccagctactcaggaggctgaggcaagagaatcgcttgaacctgggaggtggaggttgcagtgagccgagaacatgccattgcactccagcccgggcacca

SEQ ID NO: 455274 - DNA, 1485 bp, Homo sapiens
  misc_feature (30)..(30): n is a, c, g, or t
agaacaatgacgtgctgaggttagcgaggnccgcggcgtggtttaaatttcggcgacggaggctgaggccttagtcgaggcaagacgtgcgcccgagccccgccgaagcgaggccacccggagccgtgcccagtccacgccggccgtgcccggcggccttaagaacccggcaacctctgccttcttccctcttccacttggagtcgcgctccgcgcgccctcactgcagcccctgcgtcgccgggaccctcgcgcgcgaccgccgaatcgctcctgcagcagagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctccccgactggcacatcccagtggaagttgtgccggacagcaccagtgatctgtacaacttccaggtgtcacccatgccctccacctctgaagctacaacagatgaggatgaggaagggaaattacctgaggacatcatgaaggtaaagccccttcctacctgggcactcttgaagtgaccgtttctcagtgaggagagagaaccagtgaagcttccaaatcagaggatgggtagctgctgttgtcacctggctgcttgcattgtcccacaagtgccacattcacgtggcttgactggtgggaaagccaccatgggaagggaaggcaggtgggaggcctggcctctgacaggccgtcctgaagcaagccttggggcatcagacagctctgtgagtcaggcactatcagcgatgggtccctggcctgcatcctctgccccaacatgccccagccctgctagttcgggaaatgcacatcaggcttcaataatcagcctttaggatccgttaatatgatgatggctttatagaaaaagttagcaaattatcctccaggtttttttttctgcttcagttttgaaagtgaatatagtttttgcagccgggggcagtggctcatgcct

SEQ ID NO: 455275 - DNA, 861 bp, Homo sapiens
aaaaaaaaaaaaaaaaaaaaaaaaaaaaatatatatatatatatatatatatatatatgtctgatcaagtgtagggtggcaccatcacatctgctcaatcatctagaagagtttcctattaagaggaaatgattttcccagtagaattgtaggctctctcttcctgttgacttagcttcatttggaaagtgtcaagaagagaacataaatgcagctcatgtgacctgtgatctcatacttattcctaatctcaatgagacagcacagatgcactgtttattgtgtggcaagtctcttgccaattgaagaacgaaggcagctgctgaagggagggttcctctatctgttttcctaaaacacatctgagtgtttgagtatctttcatgattagaagaattaaatcagaccaaacttcaccaaaatttggatttgctcttgttctctttttctacatcattctttaaggtttttttttgtatttttaggaaaaaaaaagatactcatgtttggctactgcttgggtgaaacattatgccttggaaaccttcctactcttttgtggcttggaagaagaaaattggaaaagtgcttatgtcaaatgatatcatctgctgtataaccactaacatgtcttctaatattttgaagataaatgccttgttagtttgcccttggatttggggctttctaccactatataaacagaaatgaaggttaagttgggctttttgttagcttttcaatgctttggtaggatctttcagtaatgataatggctgccgtttttgtttgttggtttgtttgtttgttttagagatggagtctcgcgcttgttgcccaggctggagtgcagtgttgcaa

SEQ ID NO: 455276 - DNA, 822 bp, Homo sapiens
gggtttcaccatgttggccaggctggtctcgaactcctgacctcaggtgatccacctgccttcgcctcctaaagtgctgggattccaggcatgagccactgtgcccagccaatgtatttacttttaatctttttctatgtttaggtatgtatttgctgtaataaggactggttatactgcttgataacattgtcactcaaacatatatcaagagcaattttatgccatttaagtttttttagcttttcatgttgaatgcatgcgtagaattcccagtgtatttgatcagtcctctgttgattgaaacgtaggatgtttttcccttttatcaataatactggaatgaacatacaaatgaatcagtctttgagcacttccttgaatgtttccttaaaatagattcctaagagtagaattcctgttcagagttttaagcttttattgtattaaattactttctagaaaagaatgtaccagtttatattctcagcagtaatgtgtgagaatatccgtttgcctttccagcactggatgaaaacaaaaattggtctatgtgatagctacttctgaccccctgcccaaggaacagaaaataaatggtatctcagtgttttaatattttttattaggctttctgtgaagaattggaatcaatgatacaggagcaatttaagaaggggaagaaccccacaggcctattggcattacagcagattgcagattttatgaccacgaatgcaatgagagagaaagggagatatgtccaaataaagatagggcaggcgcagtggcttccacctgtaacttccagcactttgggag

SEQ ID NO: 455277 - DNA, 627 bp, Homo sapiens
tgtttgtcttttctccccatgcttgcctttttaaacaactgggagttgtttgtttttctttatattcttccatcttttggtttggaaatgacatactcttaatattcttttagtgattacccttgaaattttgctatgcatatttaacgaagtctaaaactaatattctgtcgccctcctagatacagcaaaggcatgaaagttctttaattccaattattcaactctcaagttacatgctgctgttgttcagtgttttagtccagactttttttttttctttttaaagagacacagtcttgctctgacactcagactggagtgcacaagtttttttcttttcttttttttgagacaggttctcactctgttgcccaggctggagtgcagtggcgcgatcacagctcactgcagccttgacctcctgagctttagtgatcctcccacttcagcccccaagtagctgggactacaggcacatgccgccatgaccagctattttttgtatttttttgttgaaacagggttttgccatgttgtgtaggctagtctcaaactctgggactcgagatctgcatgcctgtagtcccagctactcggaaattatttcacacaagttctttttta

SEQ ID NO: 455278 - DNA, 5734 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgcgtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaaattatgggtggaaggctcagcatgctgacgagatgcactgatactaaaacagcctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtctaaatctgggaaacag

SEQ ID NO: 455279 - DNA, 6595 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgcgtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaaattatgggtggaaggctcagcatgctgacgagatgcactgatactaaaacagcctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccaggtgagagcccagagtgtctctgactttagtgggtggtggctgtgtgaccgcctgctccaaagttattctgaaattgagagagtgactttatgaggtaagtattctaggcaaccagttacctttgttaaaaccttcatgatgagaaacggttcaggcacttttcgttgagttctagaaggagcgagcatgctgagggctgtgtccacccctctggtcatgccccttgtaatgcatgcatatgtgagggtggcacatacaccaccagctttggggctcagattcggcccgggttcagcagcgttctgtgtaaggcgctaggagagggtgggtttagggactcttgttctggtacatattgctgtctgcaacaaagtgctgcttgggttgcagaggggtgggtgcctgtaagtgtggtgcacatttacacacatttctacaaaatgactctaccttgtggcacattgaagataattgtgtaagtagttatctctgaaaactaatatgccacctaatgctttaacacctgactctgcaggggtagacgattgttggatttgtccagccgtggtcctggtttcgtgttcagtgtctgcacgtcctgccatcatcactgccacacttactgttgacagctgtccctgctgcatgctcttagccagctccatcctgtgctctcagctgatatttcacaggctgggcctggtgtgctctggtgactcagtttactgtttcaggatgcacctctctctgactgtacggaaactatcgaagggctcgagcttacagagcagacctttagtcccgctaaatctctctcttttagaaagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaaggagacggatgcgctagagagtacctgttaccctaaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtctaaatctgggaaacag

SEQ ID NO: 455280 - DNA, 7791 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgcgtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaaattatgggtggaaggctcagcatgctgacgagatgcactgatactaaaacagcctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaaggtgagctctgggtggcagcggccgccactgtgggagggtgcacggctcgtgcgcgctgtggcggaatgtggcgggagtcgtgttaacagcaacacggaagtgtgtgcttgcatcagcgccaggacgtgacacctttctcctcctatattgcttctgtcctgggtaactccaggcaaaacagatttgtatgtgagctgtgaccaggtaggaaggccggcctcgggggtcggaacccaccatggttgctggtgtccacgttgcccattgctcgcacactcctcgtgctgtgttgtcatgcagatgccaccttcggaggtgccctccgctgtgtgagccacacgccggctgcctctcagccaccgtgtgtctgtggtgtgtgatcccgggtgtctgtccctcggtctcgtacatccatgtctctcgtgaagcccgtggccctgcctttcttcttctgtaacctgatggctgtgactgaatgcatagattctctccttgtgcttttttctccctgtggctgcgtcacaagcaggagacggatgcgctagagagtacctgttaccctagtaagtaccgcgctgcctccgctctccaccggtgccctgcgctttgcctcattctcctgcttctttgttgtttattaagttttgttttctgtttatttaaaataaaaacagaagccccccttttttgtacccagtcccttggaggccttcctggaagtggttcagtcacctgagtgctgtgctgccttcagcggcagcgggtacctccacgcacctaggtgccatggagcactctgggcctcaggagttcctacctccagcctttgagggtctctttggattgcttggtgggagggttttgccacactggatcagatgtaagtgcagcctcggttcagacagggtggggttctgccacctgccgtgtggggtcagattgccttggacctttgctgaagctggtccaaaggaggtgggcagaggagcggatattggaccctcgtaaagcagtgtgatgttcactcagatgatggcagctctccagagcgagtgccctggggcagcctccgtcctagcatcagccacaccatgcccagcagagcgggccccatctcctcagggggagcggcgcctgtgtgcccatagccctttcccggttctcatgaagcgtggcctggaatcagcctggggcagctggcagggtgggggtgcttccagcttcccaaaggtaaagcactgagagtttggggcctgggcctcctgtgctgctcctaaccactcagctgactcccctggccctgatgtgtggcttgatttttaaacactaaacagcttgtggtgcctaacctgtcagttgctggtaactttgtaggccgtttacgaatggacagagcgggtgcccgggtaagtgcaaggaaggcgcccccaggctgtgtcctcagggccgctgtgctccttcacagatggccactcctgatgctgggtggagtttttgcccccactccttgccttacaggccatctctttccttttaattaacttccagcctaaacggctttgttcttttggatgttgacgtcacacaacgtgctgtgggagttatgcacgattttctactggctgttttgggggagaccaggtgttgtagacccaaatttagacttaatttcagtactactagtacatgcccttagggtgacagggcagacttctcgtcacataatgaaagcgggacgtcgctcctttagtcgtcctcagcttgtgctgcagtctgtctttccggcggggggaccaggcctgggacggagctggtgttgtcagcacactgcccaccagaaggagctaaaaactaccccgagactgagtctgtattttatgatattagctccatccagccgtacagtagagtagaccatattttaagtttcttgtcttggtaaaaatctgtagagtaaaataaaatggcagtttcgtgtgtggggctcccccatctcaagctgccctttgagatctgggcaggaacccttaatcccatctctcacctcacccactagaaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtctaaatctgggaaacag

SEQ ID NO: 455281 - DNA, 5768 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgcgtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaaattatgggtggaaggctcagcatgctgacgagatgcactgatactaaaacagcctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaaggagacggatgcgctagagagtacctgttaccctaaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtctaaatctgggaaacag

SEQ ID NO: 455282 - DNA, 5984 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttgtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccaggtgagagcccagagtgtctctgactttagtgggtggtggctgtgtgaccgcctgctccaaagttattctgaaattgagagagtgactttatgaggtaagtattctaggcaaccagttacctttgttaaaaccttcatgatgagaaacggttcaggcacttttcgttgagttctagaaggagcgagcatgctgagggctgtgtccacccctctggtcatgccccttgtaatgcatgcatatgtgagggtggcacatacaccaccagctttggggctcagattcggcccgggttcagcagcgttctgtgtaaggcgctaggagagggtgggtttagggactcttgttctggtacatattgctgtctgcaacaaagtgctgcttgggttgcagaggggtgggtgcctgtaagtgtggtgcacatttacacacatttctacaaaatgactctaccttgtggcacattgaagataattgtgtaagtagttatctctgaaaactaatatgccacctaatgctttaacacctgactctgcaggggtagacgattgttggatttgtccagccgtggtcctggtttcgtgttcagtgtctgcacgtcctgccatcatcactgccacacttactgttgacagctgtccctgctgcatgctcttagccagctccatcctgtgctctcagctgatatttcacaggctgggcctggtgtgctctggtgactcagtttactgtttcaggatgcacctctctctgactgtacggaaactatcgaagggctcgagcttacagagcagacctttagtcccgctaaatctctctcttttagaaagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaaggtgagctctgggtggcagcggccgccactgtgggagggtgcacggctcgtgcgcgctgtggcggaatgtggcgggagtcgtgttaacagcaacacggaagtgtgtgcttgcatcagcgccaggacgtgacacctttctcctcctatattgcttctgtcctgggtaactccaggcaaaacagatttgtatgtgagctgtgaccaggtaggaaggccggcctcgggggtcggaacccaccatggttgctggtgtccacgttgcccattgctcgcacactcctcgtgctgtgttgtcatgcagatgccaccttcggaggtgccctccgctgtgtgagccacacgccggctgcctctcagccaccgtgtgtctgtggtgtgtgatcccgggtgtctgtccctcggtctcgtacatccatgtctctcgtgaagcccgtggccctgcctttcttcttctgtaacctgatggctgtgactgaatgcatagattctctccttgtgcttttttctccctgtggctgcgtcacaagcaggagacggatgcgctagagagtacctgttaccctagtaagtaccgcgctgcctccgctctccaccggtgccctgcgctttgcctcattctcctgcttctttgttgtttattaagttttgttttctgtttatttaaaataaaaacagaagccccccttttttgtacccagtcccttggaggccttcctggaagtggttcagtcacctgagtgctgtgctgccttcagcggcagcgggtacctccacgcacctaggtgccatggagcactctgggcctcaggagttcctacctccagcctttgagggtctctttggattgcttggtgggagggttttgccacactggatcagatgtaagtgcagcctcggttcagacagggtggggttctgccacctgccgtgtggggtcagattgccttggacctttgctgaagctggtccaaaggaggtgggcagaggagcggatattggaccctcgtaaagcagtgtgatgttcactcagatgatggcagctctccagagcgagtgccctggggcagcctccgtcctagcatcagccacaccatgcccagcagagcgggccccatctcctcagggggagcggcgcctgtgtgcccatagccctttcccggttctcatgaagcgtggcctggaatcagcctggggcagctggcagggtgggggtgcttccagcttcccaaaggtaaagcactgagagtttggggcctgggcctcctgtgctgctcctaaccactcagctgactcccctggccctgatgtgtggcttgatttttaaacactaaacagcttgtggtgcctaacctgtcagttgctggtaactttgtaggccgtttacgaatggacagagcgggtgcccgggtaagtgcaaggaaggcgcccccaggctgtgtcctcagggccgctgtgctccttcacagatggccactcctgatgctgggtggagtttttgcccccactccttgccttacaggccatctctttccttttaattaacttccagcctaaacggctttgttcttttggatgttgacgtcacacaacgtgctgtgggagttatgcacgattttctactggctgttttgggggagaccaggtgttgtagacccaaatttagacttaatttcagtactactagtacatgcccttagggtgacagggcagacttctcgtcacataatgaaagcgggacgtcgctcctttagtcgtcctcagcttgtgctgcagtctgtctttccggcggggggaccaggcctgggacggagctggtgttgtcagcacactgcccaccagaaggagctaaaaactaccccgagactgagtctgtattttatgatattagctccatccagccgtacagtagagtagaccatattttaagtttcttgtcttggtaaaaatctgtagagtaaaataaaatggcagtttcgtgtgtggggctcccccatctcaagctgccctttgagatctgggcaggaacccttaatcccatctctcacctcacccactagaaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtctaaatctgggaaacag

SEQ ID NO: 455283 - DNA, 5959 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgcgtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaaattatgggtggaaggctcagcatgctgacgagatgcactgatactaaaacagcctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccaggtgagagcccagagtgtctctgactttagtgggtggtggctgtgtgaccgcctgctccaaagttattctgaaattgagagagtgactttatgaggtaagtattctaggcaaccagttacctttgttaaaaccttcatgatgagaaacggttcaggcacttttcgttgagttctagaaggagcgagcatgctgagggctgtgtccacccctctggtcatgccccttgtaatgcatgcatatgtgagggtggcacatacaccaccagctttggggctcagattcggcccgggttcagcagcgttctgtgtaaggcgctaggagagggtgggtttagggactcttgttctggtacatattgctgtctgcaacaaagtgctgcttgggttgcagaggggtgggtgcctgtaagtgtggtgcacatttacacacatttctacaaaatgactctaccttgtggcacattgaagataattgtgtaagtagttatctctgaaaactaatatgccacctaatgctttaacacctgactctgcaggggtagacgattgttggatttgtccagccgtggtcctggtttcgtgttcagtgtctgcacgtcctgccatcatcactgccacacttactgttgacagctgtccctgctgcatgctcttagccagctccatcctgtgctctcagctgatatttcacaggctgggcctggtgtgctctggtgactcagtttactgtttcaggatgcacctctctctgactgtacggaaactatcgaagggctcgagcttacagagcagacctttagtcccgctaaatctctctcttttagaaagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaaggagacggatgcgctagagagtacctgttaccctaaccttgtgccggagccgactactggagatgacagtgatgctgccacctttaagccaactctccccgatctgtcccctgatgaaccttcagaagcactcggttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtctaaatctgggaaacag

SEQ ID NO: 455284 - DNA, 5681 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgcgtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaaattatgggtggaaggctcagcatgctgacgagatgcactgatactaaaacagcctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtctaaatctgggaaacag

SEQ ID NO: 455285 - DNA, 5705 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgcgtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaaattatgggtggaaggctcagcatgctgacgagatgcactgatactaaaacagcctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatcacctcaaactttcctcctccttggctttaatgaggtttgacagagtcagcggccctctccaataataaatataagagtt

SEQ ID NO: 455286 - DNA, 5176 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgcgtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaaattatgggtggaaggctcagcatgctgacgagatgcactgatactaaaacagcctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacaaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtctaaatctgggaaacag

SEQ ID NO: 455287 - DNA, 4616 bp, Homo sapiens
  misc_feature (53)..(53): n is a, c, g, or t
  misc_feature (4401)..(4401): n is a, c, g, or t
  misc_feature (4469)..(4469): n is a, c, g, or t
  misc_feature (4480)..(4480): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgcgtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaaattatgggtggaaggctcagcatgctgacgagatgcactgatactaaaacagcctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccgatctgtcccctgatgaaccttcagaagcactcggnttcccaatgttagagaaggaggaggaagcccatagacccccaagccccactgaggcccctactgaggncagccccgagncagccccagacccagccccggtggctgtaagaggctgccccctcagctgtcgaggagggggccgccgcggatcctgcagcgatggtctccaggcaagtccctgtgtcccagctatgagttatattccatacctcgg

SEQ ID NO: 455288 - DNA, 4353 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgcgtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaaattatgggtggaaggctcagcatgctgacgagatgcactgatactaaaacagcctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgaaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtctaaatctgggaaacag

SEQ ID NO: 455289 - DNA, 4927 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgcgtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaaattatgggtggaaggctcagcatgctgacgagatgcactgatactaaaacagcctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccaggtgagagcccagagtgtctctgactttagtgggtggtggctgtgtgaccgcctgctccaaagttattctgaaattgagagagtgactttatgaggtaagtattctaggcaaccagttacctttgttaaaaccttcatgatgagaaacggttcaggcacttttcgttgagttctagaaggagcgagcatgctgagggctgtgtccacccctctggtcatgccccttgtaatgcatgcatatgtgagggtggcacatacaccaccagctttggggctcagattcggcccgggttcagcagcgttctgtgtaaggcgctaggagagggtgggtttagggactcttgttctggtacatattgctgtctgcaacaaagtgctgcttgggttgcagaggggtgggtgcctgtaagtgtggtgcacatttacacacatttctacaaaatgactctaccttgtggcacattgaagataattgtgtaagtagttatctctgaaaactaatatgccacctaatgctttaacacctgactctgcaggggtagacgattgttggatttgtccagccgtggtcctggtttcgtgttcagtgtctgcacgtcctgccatcatcactgccacacttactgttgacagctgtccctgctgcatgctcttagccagctccatcctgtgctctcagctgatatttcacaggctgggcctggtgtgctctggtgactcagtttactgtttcaggatgcacctctctctgactgtacggaaactatcgaagggctcgagcttacagagcagacctttagtcccgctaaatctctctcttttagaaaggtactcactgccctgtcctcactacctgtctatgcgccttgctcccctcccctcccccctccccgtctcctctcttcaggcattgtcttagttactgaagtagcttcaaatggatctttaacctgtttgtgagattgtacagaaggttctgttctatctacttgattctttaattaaaacatttgctatgaggtgtgataacaatttccagcattcgaagttgttactgagaaatggccagtctgagcaacgtggtgcatttctgcagttccgcacgggactttggtcagtgcgtgttttgggtttcagaatttgccttttccatgactctgactgcagacagcctcttctgggcagtctgttgctgttggcagcggccactcccgagtgcccttccaccctcgctggttcaactttgactgtaaatgtcatgaatgtagccactagaggtcatatcattgaaagatgtcatttcagaggaatgggaattcagacagtctttgtcagcccttgataaaatgtatttatttgtacctcaaa

SEQ ID NO: 455290 - DNA, 4071 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgcgtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaaattatgggtggaaggctcagcatgctgacgagatgcactgatactaaaacagcctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaaggtgcgtcctgcgtcggcactcagcgggggcttgggtgtgggattggaagggatgccagctgctttggggggagcgggtgcttgcttctagcagagggcatctgctgttgttgccactgttgcagtgaagccatctcttcacaccgctgctgttctaccaccagtgtgaagtatgagcagcagacattttttgggccctattgattcttgaactgatgtttgctcacgatgtttgctcaccggtcagaattggaagctgcaaaacctgttcttagcaagagcagactgctgtccctttcagggttcgttcaaagacttgtgagtggcatttggtgtatcagagcaggagccctgccagtgctcacatcactagacgatggacatgcagcgagtgtttcccccaagttaatgacagtgagagataggtgtcctgcccaagcatctggaagatgtggggagctgggaatagtctccatccctgcagacccacgccccactaagcaggcatggcggtcactcagaacacatggggccatcctgcctgcgtggggcagtgggagagctgaaatgtagcttccatgtggctggggcccaagtgcaca

SEQ ID NO: 455291 - DNA, 1538 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggtaggggacagccattccagtcactctgcagtttatttagatgtgtctggggttcacatagatttttttttgatacttatcgagtaggagaggagtctttgagcaatctctttgccaaagataagctcatggatttgggacttgatcaggacaaatgctgtttcactgattgaagttggcaaaggattactgggcttttcatttctaatttttaaattttcaaatatgtcagtcactaccatttatggagtactggtgtgtataggcctggcatcaggtgcttagtgtgtgtcatcgcatatgtgatgtcacgtgacccccacagtactctttgaaaaagcaggtatacagaagtagagactcagagacttgcctgcagcttacagctgtgagttcccctccgctccgtcagccgttagttcacgttctcccctctgcttcttgacttatgtctgtggcgtagtgaagtcccaagtcctttgtaggatcctgaaaggtgctgtgttttctcatttctctgccaactttggtgcccaatatttttgtcatgctaaagaaatacttctgaaagtaactttgtgatcagtctgtcactatccattctacattttttattcttacactctagagatttggtttcttttgaaacctacatttttattcaagtcatctgaccctcttgatctcagtaaggaactcaagccatgctgtgtgtgttttggaaaaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagaggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtctaaatctgggaaacag

SEQ ID NO: 455292 - DNA, 520 bp, Homo sapiens
tgtcgccctcctagatacagcaaaggcatgaaagttctttaattccaattattcaactctcaagttacatgctgctgttgttcagtgttttagtccagactttttttttttctttttaaagagacacagtcttgctctgacactcagactggagtgcacaagtttttttcttttcttttttttgagacaggttctcactctgttgcccaggctggagtgcagtggcgcgatcacagctcactgcagccttgacctcctgagctttagtgatcctcccacttcagcccccaagtagctgggactacaggcacatgccgccatgaccagctattttttgtatttttttgttgaaacagggttttgccatgttgtgtaggctagtctcaaactctgggactcgagatctgcctgcctcagtctcccagagtgctaggattacaggcgtgcaccaccattgggcatggtggtgcatgcctgtagtcccagctactcggaaattatttcacacaagttctttttt

SEQ ID NO: 455293 - DNA, 706 bp, Homo sapiens
tattttcagactgtctgtgttctgtttcatgggtatattagttttttgtggctcctgtaacaagttaccacatacgtggtgctttaaaacagcagaaattattctctcatagttctggaggccagaagtttgaaaacaatatcactggaccaaaatcaaggtgtcactagggctgtgcattcttcctctggaggtcgtatgggagaatctgttcctcgcctcttccagcttctcatggctgccacattccttggctgtggctgcatcactccaatctttgtgacccaggtcagattggtttcttgtcttctgtgtggttaaatctcccccacctcgattttataaggatactggtgattacattcagggcccacccaggtaatccaggataatttcacaatcccaaaatacttaattatatctgtagtctttgccatataaagtaatatttacaggttccaggcattattcagacctgttaacttggggaccgttactcagcttactaaaagagtgtctcttataagttacctgtaatttctgtcttttaactggcataatttagtacatttatgttatgattcagataaatttgtactttctttatcatcttaggtttgtattctgtttgtcttttctccccatgcttgcctttttaaacaactgggagttgtttgtttttctttatattcttccatcttttggt

SEQ ID NO: 455294 - DNA, 214 bp, Homo sapiens
gtgaatcaggccggcttcaccttacactctgcaatttatgctgcacgcccggacgtgaagtgcgtcgtgcacattcacaccccagcaggggctgcggtgagtggctgccctggtagcatctcaaggtctaaagctgctgagtgaaaggcactgcacgtttcctctgaattgcccttgttgtttatagtcagtaaaactaattttgttgaatata

SEQ ID NO: 455295 - DNA, 664 bp, Homo sapiens
agtagaataatggaaagcttccagtaccccttggcttcgtgacaggcattgtgcatggacgcttccctgcatagctcactcagtgttctgaacaaacccgtgaatttgtagcctgaaagagatgcaaataatttcacttggatctttgagctaattcagtcattttccccacagaccagagtgaactccgagcaggaacacttcctcattgtcccttttgggcttctttacagtgaagtgactgcatccagtttggtaagaatgtccttctctttggcagcttgtatgtgcaggtcatgttaggtcattcaacatcttcagatcagctaaatatgtaaaacccaagaaacaagaaagagcctatgttttatgtggtgtgttcagttagagaaaaacctttgagagaagttacaaatattgtaatcttgagtttgaatagtttctagttagggtaatttgaagtcctcttgggctggggtgcagtggctcatgcctgtaattccagtacttaagttcgagaccagcctggccaacatggcggtaccccaactctacaaaaaaataccaaaattagctgggcatggtggtgggaggattgtttgaacctgggaggtggaggccgaggtcgcaccactgcactccagcctgggcgacagagccagac

SEQ ID NO: 455296 - DNA, 696 bp, Homo sapiens
cacttgctctacgtcatctaactatgaacagtaaggtaggcacagacccagcagttggtaatacagcttggcacgcagacaccggacgagagagactgcaccaagggtttcacgtgatcgtgtgtaatgttcgtccacaccttagtcttcgacttgggactgcttccattctgcccttcctcggaagcttcgtcgccccggccagagttcagccatcttgtcttctccgaagggatgccgctgctgttctaccaccagtgtgaagtatgagcagcagacattttttgggccctattgattcttgaactgatgtttgctcacgatgtttgctcaccggtcagaattggaagctgcaaaacctgttcttagcaagagcagactgctgtccctttcagggttcgttcaaagacttgtgagtggcatttggtgtatcagagcaggagccctgccagtgctcacatcactagacgatggacatgcagcgagtgtttcccccaagttaatgacagtgagagataggtgtcctgcccaagcatctggaagatgtggggagctgggaatagtctccatccctgcagacccacgccccactaagcaggcatggcggtcactcagaacacatggggccatcctgcctgcgtggggcagtgggagagctgaaatgtagcttccatgtggctggggcccaagtgcaca

SEQ ID NO: 455297 - DNA, 5675 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgcgtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccacctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtctaaatctgggaaacag

SEQ ID NO: 455298 - DNA, 3734 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggtaggggacagccattccagtcactctgcagtttatttagatgtgtctggggttcacatagatttttttttgatacttatcgagtaggagaggagtctttgagcaatctctttgccaaagataagctcatggatttgggacttgatcaggacaaatgctgtttcactgattgaagttggcaaaggattactgggcttttcatttctaatttttaaattttcaaatatgtcagtcactaccatttatggagtactggtgtgtataggcctggcatcaggtgcttagtgtgtgtcatcgcatatgtgatgtcacgtgacccccacagtactctttgaaaaagcaggtatacagaagtagagactcagagacttgcctgcagcttacagctgtgagttcccctccgctccgtcagccgttagttcacgttctcccctctgcttcttgacttatgtctgtggcgtagtgaagtcccaagtcctttgtaggatcctgaaaggtgctgtgttttctcatttctctgccaactttggtgcccaatatttttgtcatgctaaagaaatacttctgaaagtaactttgtgatcagtctgtcactatccattctacattttttattcttacactctagagatttggtttcttttgaaacctacatttttattcaagtcatctgaccctcttgatctcagtaaggaactcaagccatgctgtgtgtgttttggaaaaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtctaaatctgggaaacag

SEQ ID NO: 455299 - DNA, 6297 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgcgtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaaattatgggtggaaggctcagcatgctgacgagatgcactgatactaaaacagcctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaaggtgagctctgggtggcagcggccgccactgtgggagggtgcacggctcgtgcgcgctgtggcggaatgtggcgggagtcgtgttaacagcaacacggaagtgtgtgcttgcatcagcgccaggacgtgacacctttctcctcctatattgcttctgtcctgggtaactccaggcaaaacagatttgtatgtgagctgtgaccaggtaggaaggccggcctcgggggtcggaacccaccatggttgctggtgtccacgttgcccattgctcgcacactcctcgtgctgtgttgtcatgcagatgccaccttcggaggtgccctccgctgtgtgagccacacgccggctgcctctcagccaccgtgtgtctgtggtgtgtgatcccgggtgtctgtccctcggtctcgtacatccatgtctctcgtgaagcccgtggccctgcctttcttcttctgtaacctgatggctgtgactgaatgcatagattctctccttgtgcttttttctccctgtggctgcgtcacaagcaggagacggatgcgctagagagtacctgttaccctaaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtctaaatctgggaaacag

SEQ ID NO: 455300 - DNA, 5681 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgcgtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaaattatgggtggaaggctcagcatgctgacgagatgcactgatactaaaacagcctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtctaaatctgggaaacag

SEQ ID NO: 455301 - DNA, 5721 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgcgtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaaattatgggtggaaggctcagcatgctgacgagatgcactgatactaaaacagcctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtccgttgggcgaggttaacatttttttctcgcccttttttttcttttatacagaaaccggggcg

SEQ ID NO: 455302 - DNA, 5694 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgcgtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaaattatgggtggaaggctcagcatgctgacgagatgcactgatactaaaacagcctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtctaaatctgggaaacag

SEQ ID NO: 455303 - DNA, 4907 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgcgtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaaattatgggtggaaggctcagcatgctgacgagatgcactgatactaaaacagcctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggagacccaagtgaaaaagaaaaaaagttggcggccg

SEQ ID NO: 455304 - DNA, 4830 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgcgtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaaattatgggtggaaggctcagcatgctgacgagatgcactgatactaaaacagcctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaaggtgagctctgggtggcagcggccgccactgtgggagggtgcacggctcgtgcgcgctgtggcggaatgtggcgggagtcgtgttaacagcaacacggaagtgtgtgcttgcatcagcgccaggacgtgacacctttctcctcctatattgcttctgtcctgggtaactccaggcaaaacagatttgtatgtgagctgtgaccaggtaggaaggccggcctcgggggtcggaacccaccatggttgctggtgtccacgttgcccattgctcgcacactcctcgtgctgtgttgtcatgcagatgccaccttcggaggtgccctccgctgtgtgagccacacgccggctgcctctcagccaccgtgtgtctgtggtgtgtgatcccgggtgtctgtccctcggtctcgtacatccatgtctctcgtgaagcccgtggccctgcctttcttcttctgtaacctgatggctgtgactgaatgcatagattctctccttgtgcttttttctccctgtggctgcgtcacaagcaggagacggatgcgctagagagtacctgttaccctagtaagtaccgcgctgcctccgctctccaccggtgccctgcgctttgcctcattctcctgcttctttgttgtttattaagttttgttttctgtttatttaaaataaaaacagaagccccccttttttgtacccagtcccttggaggccttcctggaagtggttcagtcacctgagtgctgtgctgccttcagcggcagcgggtacctccacgcacctaggtgccatggagcactctgggcctcaggagttcctacctccagcctttgagggtctctttggattgcttggtgggagggttttgccacactggatcagatgtaagtgcagcctcggttcagacagggtggggttctgccacctgccgtgtggggtcagattgccttggaccttaaatgtacctggtactatgtgcaattcgcattcctcctcactgtcggccgtttctccagat

SEQ ID NO: 455305 - DNA, 4010 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgcgtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaaattatgggtggaaggctcagcatgctgacgagatgcactgatactaaaacagcctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccttgcatatatggacaccgacttgggaggacaggtcctgaatgtcctttctccagtgtaacatgttttactcacaaataaaattctttcagcaagttccttgtctaaatctgggaaacag

SEQ ID NO: 455306 - DNA, 3091 bp, Homo sapiens
  misc_feature (53)..(53): n is a, c, g, or t
cttccccaactctcgctccctcgtatataccgggttatcctcattaccatggncttctgcttgctgaactaggaactggtcggcttcagacaacgtctgggcctagaagccccgttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgaagaatggtgccaccacttgatgataaaccttttgttctaaaagcatcagtgttggtgttcttacagcaagtgcgattgctgtcttttatgcagtatctgaataccttcaccttcaaagtcatgaagaagcactagggttgtttaacttctgaggtaaattacaataaaatgtagaggtgaaggattcctggtattgttttattttttaaagataaccttgtgtttggactcagtggggacaagagcacagagaatgcgtaggcagctggatgaccagctgtgtcagctcagtccccaccatcccacaagcaagcgagagaggtggcacttttgaaatcggtcagtcaggtatttaggcttttgtcttaacagcaaatcctggctgtctggggcctgatgactgtgttccatgggtatccactccctgtccacagcgtgggagcccctcagctgcttattgcagggacacagagcccggcatggtccagaaggcgggcttatggggcctgcagcacacagggaaagtgagcccacactgtgataggagggcagacacacaggatgtgttctgtgttacagggttgccgtgaagaatttcattcttttgcaaggactggagagaaaattttatgtggaaggtagcccttggaaatgacctcaaagaataggtaggatcttagcctgcgtttgaaagcctggaaaaaaacaggatgacaggatgaagaggccacagcacagctgcagacaatgggagtggggagatgggaacatgcaacgtacggtgcacctttcaggttcatcttgactttaccaggatcattaaatactcagttcttagagctgtattagaacactgcccttggggtctcagtcccgcagccacatcatcagacacagggctctggaacagatcccttccatgctgcacatcagacctcttagatgggggtcacgatggtccgtcctaacgccacatgacctcaagtggtgtagatgtgaggacatgtcagtgtggggaaagaaggcctcagaggggccagtatccttgtatgctgccagccagtactggacaagtgggcacgttccagcctaagacaggcgtggcccttggaccagatcacagatgagatgggtggcttcaggaagcagggtggcttcaggaggcaggaagtttaactttcctgaaggtttggaataaaaagtattcataggtctgattcaggctatgttaaatgttcttactgaaattctttgcacttgggatgaatattgtccgctagaaaggaggaactgagggttttctgcctgggcgcgatagtcagtcagtggagtagactcaatcagtgacacagggacgaacagagaaggcagagtctagcgtaactttttgagttcatataatcagtgaggttgattgcattaattgactgtctactgttgagtcatgaacaggacacagttcttgccctcaggagtttatgacctaataagagagatggacaaacgattcccaaatgagccctgcccctgtgatctgtgcagtcataggcatgatgagagcttgcaggcagaggtgggtgccgattggtcaaggaggtaggaagaggagcaaaagctcatgaagaaggctgaagaagcagttagagttgggtggccagccagggtagtgaagctgcagggactcatagatggagaaagcttgagagtggggcagccatggcccaggtgtgcgtcaggagccaggtcatccagcatggctgtgcaaggtaaggagggctgaggttggcccagtcacacagcccctgcctcctggtaaatacggcgacattttgctgctcttctacttacagtcagtgtgagggaggagagaggggggtcagaatgcacagcagccaccaaagactgtgctgaaagcacatcctagaaggcggagagggggaagtcaaaatcaggtagaaactctgatttggtagggaaggaagataaggatgaatgattaataagtaaaacattcattacaaaaagcatgatgaatgtttactcagtgtccttaatgtgtacagattgttttaatattagaaggccatatagtttataagaaataaactagacagcaatcactaatcatagtccatgttttaatttagcatcggggttggcatatatgttgtttgctaataactgagtagagaatagttgccaatttccacactataatatatgttgcagccgagcacagtggctcactcctgtgatcccagcacttcaggaggctgaggtgggagaccaggagcttaagaccagcctgggcaacatagcgagattcctctccacaaaaaataaaaaaatttcaaaaagagagataatatttcatttgaacttctacagttagaaaaaaaatgctaaattgtcccccccccccaaaaaaaatcaagatataatttcagtttctcaaagaaggaacaaatccatatatattttctctttctttttttttttggagagacaggatgtcgtcatgttgcctaggctggtgttgaactcctgggctgaagcagtcctcccacctcagcctcccaaagtgctaggattatgggtgtaaactaccacgcctgacccaaatccatgtttttaactacaagccagatagtagttctgaggtctgagtattacttctggttttggtttaacagcatttaaa

SEQ ID NO: 455307 - DNA, 1013 bp, Homo sapiens
ttgtaggaattcgcagtgtaggggaaatggtacagattttataatcaggaaagacctgtattcagttctccatttgaccactttctgccagagccatgggaacagttttttaatttctctgaccctgtttcctcacttgggaatatgacttttgcagatctgttggaaaatattaaggccaagagggatttaaaatgagatgttgtctagcactgagtaggagcttaatatctatccgttcctttctgcttcagtcaaaactgagcttcatatgtagaatgattattgtttgtattacattctccattttgagtatggaaccatgaatgccaacagcttgataataaaaggagccgtttgtcaagagacagtcctgtaagcgctttttaacctggtagactgtgcatgtaagggcaggcaggttacaaatgcgaatccccatagccagcacactctacatacagcagattcttaagccatctgtgtactctttttaacactgtactgaagtccacttaagtcagagttcaacaaaatgaatgaatgtaatcccaggactatggaacttctctgtgattacatagcacagagaactacggaatcattttctggaagaatgcaccatgcgattatgctccatgtggaattggtatatataaatgttggtagactgtgaggatgaggttgacaggttgatctgagtagagaccctaggaggaaccgaggatactatgtagttttgttgttgttactgttttgcagttcctggctgctctgtgttggcagctgtgtgcacgctttctcttttgagccagcgaggcacaagacaagtaatttcccatcttgaatctctcacagctgctgagctgtagtggatatactgggatgtggctatgaactttaaaaatttgcataaatccagcccctactcccctgcaaaggctcagtcttgtctttacaccttccccgaggtaattattttctggggggtaggggtgggggttgggagggtg

SEQ ID NO: 455308 - DNA, 1016 bp, Homo sapiens
  misc_feature (65)..(65): n is a, c, g, or t
  misc_feature (251)..(251): n is a, c, g, or t
ggtactactggacgaaatgatcagatctccaggctattgtgacatacatctgagctgatctgtgncttgaataacttcactgcgacaatacatacaaactatgtctcagtgatctacttcctccctcctcatagactccactgctgcaagacacaacgttgggcaggtcaccttctgtactctatctcctcacacaagagcaagcctcgtagagtccgttaccgacctggcaagctactcctcagtttacnaggaaacatctccagactgctgttaaactgctgagcctagaaccaatgtttcatgtgaattcgccactataacgtaggattgcttcagaacctgcagcatttgcatatcactgggaacaaagtggacattctgccaaaacaattgtttaaatgcataaagttgaggactttgaatctgggacagaactgcatcacctcactcccagagaaagttggtcagctctcccagctcactcagctggagctgaaggggaactgcttggaccgcctgccagcccagctgggccagtgtcggatgctcaagaaaagcgggcttgttgtggaagatcacctttttgataccctgccactcgaagtcaaagaggcattgaatcaagacataaatattccctttgcaaatgggatttaaactaagataatatatgcacagtgatgtgcaggaacaacttcctagattgcaagtgctcacgtacaagttattacaagataatgcattttaggagtagatacatcttttaaaataaaacagagaggatgcatagaaggctgatagaagacataactgaatgttcaatgtttgtagggttttaagtcattcatttccaaatcatttttttttttcttttggggaaagggaaggaaaaattataatcactaatcttggttctttttaaattgtttgtaacttggatgctgccgctactgaatgtttacaaattgcttgcctgctaaagtaaatgattaaattgacattttcttactata

SEQ ID NO: 455309 - DNA, 1363 bp, Homo sapiens
gcgtgggctcttgggagcgggacttctgctcaaatcctgtccaggggcttgaaaaggaggagaattgggggtggttgccgggaggaccagcacctccagttactggagggttgataggggccttctcctttccgtcaccctttactagggggtatcccttgcagataaatgagattttttgatttcttaaaaagccagctgcagtgaagaagaactgctgcaggtcgaggggaagagaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagcaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcccaaaacatgctcaaaagtagaacattttgtttcaatattaggaaagtgctttgaatccccttggacgacaaaagcgttgtctgagacagcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaatcctggataaaaaggatggagagcaggccaaagccctgtttgagaaagtgaggaagttccgtgcccatgtggaagatagtgacttgatctataaactctatgtggtccaaacagcttctccctttcccaaccaataaagtaaccactttcagcac

SEQ ID NO: 455310 - DNA, 859 bp, Homo sapiens
gggccaccggagaaagcgctcgcaatcacatggaggcccgggcccgccccattggctgcggccgggccagtcgcggcactcgccggctgcggttggtcccagagctgcagcgcctgcacgggcccggagtccatgttacgctttgtctaattcccctcgttacagagtcatgtgctgctgctcccgtcgccgctgtctgccgctgccgccgcccgtggtgccccggctcctccgccgcgcttcgaggtggcagccgcgggcggggccgcgggagcagggtccagggtgcagcgcgccttcgccgccccggcgcgtcccggtgcagccgccgcccgccgcgggtgatgccgccacctccggcctcagcataagccgtggcttggcggccgagctgcaccccaaggttggtgcgcacctctcccggcaggggccgggggctgcgagggaaggcgacgcgcaggtggagccgcgccgagccggagcgcgcaaccctggcgcaggcgccgcggcccgagctgcggttgcggccgggaactcattcggggacgtccgggggtcgggaggaggtggcggcgagcggagtgggctcccgtttgctgccgccagggcctgggagattgttccgctttctgcagtctgagcgtcggccgcttcggccccgggcggccggccctgcgggaggggagtgcggcttcctggctcctgaacccctcgcgcgcgctcccttctctcacctccctccgccctatcggaaaggcggggagagccggtttcggctctgctggttcctcccggaggtgggtgtttggtgtctggccttgctggcccggcgtccaaaggtgagccctttaacttctcc

SEQ ID NO: 455311 - DNA, 3318 bp, Homo sapiens
gcgtgggctcttgggagcgggacttctgctcaaatcctgtccaggggcttgaaaaggaggagaattgggggtggttgccgggaggaccagcacctccagttactggagggttgataggggccttctcctttccgtcaccctttactagggggtatcccttgcagataaatgagattttttgatttcttaaaaagccagctgcagtgaagaagaactgctgcaggtcgaggggaagagaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagcaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcccaaaacatgctcaaaagtagaacattttgtttcaatattaggaaagtgctttgaatccccttggacgacaaaagcgttgtctgagacagcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaatcctggataaaaaggatggagagcaggccaaagccctgtttgagaaagtgaggaagttccgtgcccatgtggaagatagtgacttgatctataaactctatgtggtccaaacagttatcaaaacagccaagttcatttttattctctgctatacagcgaactttgtcaacgcaatcagctttgaacacgtctgcaagcccaaagttgagcatctgattggttatgaggtatttgagtgcacccacaatatggcttacatgttgaaaaagcttctcatcagttacatatccattatttgtgtttatggctttatctgcctctacactctcttctggttattcaggatacctttgaaggaatattctttcgaaaaagtcagagaagagagcagttttagtgacattccagatgtcaaaaacgattttgcgttccttcttcacatggtagaccagtatgaccagctatattccaagcgttttggtgtgttcttgtcagaagttagtgaaaataaacttagggaaattagtttgaaccatgagtggacatttgaaaaactcaggcagcacatttcacgcaacgcccaggacaagcaggagttgcatctgttcatgctgtcgggggtgcccgatgctgtctttgacctcacagacctggatgtgctaaagcttgaactaattccagaagctaaaattcctgctaagatttctcaaatgactaacctccaagagctccacctctgccactgccctgcaaaagttgaacagactgcttttagctttcttcgcgatcacttgagatgccttcacgtgaagttcactgatgtggctgaaattcctgcctgggtgtatttgctcaaaaaccttcgagagttgtacttaataggcaatttgaactctgaaaacaataagatgataggacttgaatctctccgagagttgcggcaccttaagattctccacgtgaagagcaatttgaccaaagttccctccaacattacagatgtggctccacatcttacaaagttagtcattcataatgacggcactaaactcttggtactgaacagccttaagaaaatgatgaatgtcgctgagctggaactccagaactgtgagctagagagaatcccacatgctattttcagcctctctaatttacaggaactggatttaaagtccaataacattcgcacaattgaggaaatcatcagtttccagcatttaaaacgactgacttgtttaaaattatggcataacaaaattgttactattcctccctctattacccatgtcaaaaacttggagtcactttatttctctaacaacaagctcgaatccttaccagtggcagtatttagtttacagaaactcagatgcttagatgtgagctacaacaacatttcaatgattccaatagaaataggattgcttcagaacctgcagcatttgcatatcactgggaacaaagtggacattctgccaaaacaattgtttaaatgcataaagttgaggactttgaatctgggacagaactgcatcacctcactcccagagaaagttggtcagctctcccagctcactcagctggagctgaaggggaactgcttggaccgcctgccagcccagctgggccagtgtcggatgctcaagaaaagcgggcttgttgtggaagatcacctttttgataccctgccactcgaagtcaaagaggcattgaatcaagacataaatattccctttgcaaatgggatttaaactaagataatatatgcacagtgatgtgcaggaacaacttcctagattgcaagtgctcacgtacaagttattacaagataatgcattttaggagtagatacatcttttaaaataaaacagagaggatgcatagaaggctgatagaagacataactgaatgttcaatgtttgtagggttttaagtcattcatttccaaatcatttttttttttcttttggggaaagggaaggaaaaattataatcactaatcttggttctttttaaattgtttgtaacttggatgctgccgctactgaatgtttacaaattgcttgcctgctaaagtaaatgattaaattgacattttcttactata

SEQ ID NO: 455312 - DNA, 3482 bp, Homo sapiens
gggccaccggagaaagcgctcgcaatcacatggaggcccgggcccgccccattggctgcggccgggccagtcgcggcactcgccggctgcggttggtcccagagctgcagcgcctgcacgggcccggagtccatgttacgctttgtctaattcccctcgttacagagtcatgtgctgctgctcccgtcgccgctgtctgccgctgccgccgcccgtggtgccccggctcctccgccgcgcttcgaggtggcagccgcgggcggggccgcgggagcagggtccagggtgcagcgcgccttcgccgccccggcgcgtcccggtgcagccgccgcccgccgcgggtgatgccgccacctccggcctcagcataagccgtggcttggcggccgagctgcaccccaaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagcaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcccaaaacatgctcaaaagtagaacattttgtttcaatattaggaaagtgctttgaatccccttggacgacaaaagcgttgtctgagacagcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaatcctggataaaaaggatggagagcaggccaaagccctgtttgagaaagtgaggaagttccgtgcccatgtggaagatagtgacttgatctataaactctatgtggtccaaacagttatcaaaacagccaagttcatttttattctctgctatacagcgaactttgtcaacgcaatcagctttgaacacgtctgcaagcccaaagttgagcatctgattggttatgaggtatttgagtgcacccacaatatggcttacatgttgaaaaagcttctcatcagttacatatccattatttgtgtttatggctttatctgcctctacactctcttctggttattcaggatacctttgaaggaatattctttcgaaaaagtcagagaagagagcagttttagtgacattccagatgtcaaaaacgattttgcgttccttcttcacatggtagaccagtatgaccagctatattccaagcgttttggtgtgttcttgtcagaagttagtgaaaataaacttagggaaattagtttgaaccatgagtggacatttgaaaaactcaggcagcacatttcacgcaacgcccaggacaagcaggagttgcatctgttcatgctgtcgggggtgcccgatgctgtctttgacctcacagacctggatgtgctaaagcttgaactaattccagaagctaaaattcctgctaagatttctcaaatgactaacctccaagagctccacctctgccactgccctgcaaaagttgaacagactgcttttagctttcttcgcgatcacttgagatgccttcacgtgaagttcactgatgtggctgaaattcctgcctgggtgtatttgctcaaaaaccttcgagagttgtacttaataggcaatttgaactctgaaaacaataagatgataggacttgaatctctccgagagttgcggcaccttaagattctccacgtgaagagcaatttgaccaaagttccctccaacattacagatgtggctccacatcttacaaagttagtcattcataatgacggcactaaactcttggtactgaacagccttaagaaaatgatgaatgtcgctgagctggaactccagaactgtgagctagagagaatcccacatgctattttcagcctctctaatttacaggaactggatttaaagtccaataacattcgcacaattgaggaaatcatcagtttccagcatttaaaacgactgacttgtttaaaattatggcataacaaaattgttactattcctccctctattacccatgtcaaaaacttggagtcactttatttctctaacaacaagctcgaatccttaccagtggcagtatttagtttacagaaactcagatgcttagatgtgagctacaacaacatttcaatgattccaatagaaataggattgcttcagaacctgcagcatttgcatatcactgggaacaaagtggacattctgccaaaacaattgtttaaatgcataaagttgaggactttgaatctgggacagaactgcatcacctcactcccagagaaagttggtcagctctcccagctcactcagctggagctgaaggggaactgcttggaccgcctgccagcccagctgggccagtgtcggatgctcaagaaaagcgggcttgttgtggaagatcacctttttgataccctgccactcgaagtcaaagaggcattgaatcaagacataaatattccctttgcaaatgggatttaaactaagataatatatgcacagtgatgtgcaggaacaacttcctagattgcaagtgctcacgtacaagttattacaagataatgcattttaggagtagatacatcttttaaaataaaacagagaggatgcatagaaggctgatagaagacataactgaatgttcaatgtttgtagggttttaagtcattcatttccaaatcatttttttttttcttttggggaaagggaaggaaaaattataatcactaatcttggttctttttaaattgtttgtaacttggatgctgccgctactgaatgtttacaaattgcttgcctgctaaagtaaatgattaaattgacattttcttactata

SEQ ID NO: 455313 - DNA, 3285 bp, Homo sapiens
ccgggccgaggccgcgccacctcggcaccacgcgggcagccggtgcggcggggtcgccacggccaggggagcgctgggtgcccaccatggcagttatgcaagcggtgaccccctggtcttgcctccccgccgccctgcactccttcctccccgctgccgacacttggatctctctagctctttctctcccctgtgttttcaaacaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagcaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcccaaaacatgctcaaaagtagaacattttgtttcaatattaggaaagtgctttgaatccccttggacgacaaaagcgttgtctgagacagcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaatcctggataaaaaggatggagagcaggccaaagccctgtttgagaaagtgaggaagttccgtgcccatgtggaagatagtgacttgatctataaactctatgtggtccaaacagttatcaaaacagccaagttcatttttattctctgctatacagcgaactttgtcaacgcaatcagctttgaacacgtctgcaagcccaaagttgagcatctgattggttatgaggtatttgagtgcacccacaatatggcttacatgttgaaaaagcttctcatcagttacatatccattatttgtgtttatggctttatctgcctctacactctcttctggttattcaggatacctttgaaggaatattctttcgaaaaagtcagagaagagagcagttttagtgacattccagatgtcaaaaacgattttgcgttccttcttcacatggtagaccagtatgaccagctatattccaagcgttttggtgtgttcttgtcagaagttagtgaaaataaacttagggaaattagtttgaaccatgagtggacatttgaaaaactcaggcagcacatttcacgcaacgcccaggacaagcaggagttgcatctgttcatgctgtcgggggtgcccgatgctgtctttgacctcacagacctggatgtgctaaagcttgaactaattccagaagctaaaattcctgctaagatttctcaaatgactaacctccaagagctccacctctgccactgccctgcaaaagttgaacagactgcttttagctttcttcgcgatcacttgagatgccttcacgtgaagttcactgatgtggctgaaattcctgcctgggtgtatttgctcaaaaaccttcgagagttgtacttaataggcaatttgaactctgaaaacaataagatgataggacttgaatctctccgagagttgcggcaccttaagattctccacgtgaagagcaatttgaccaaagttccctccaacattacagatgtggctccacatcttacaaagttagtcattcataatgacggcactaaactcttggtactgaacagccttaagaaaatgatgaatgtcgctgagctggaactccagaactgtgagctagagagaatcccacatgctattttcagcctctctaatttacaggaactggatttaaagtccaataacattcgcacaattgaggaaatcatcagtttccagcatttaaaacgactgacttgtttaaaattatggcataacaaaattgttactattcctccctctattacccatgtcaaaaacttggagtcactttatttctctaacaacaagctcgaatccttaccagtggcagtatttagtttacagaaactcagatgcttagatgtgagctacaacaacatttcaatgattccaatagaaataggattgcttcagaacctgcagcatttgcatatcactgggaacaaagtggacattctgccaaaacaattgtttaaatgcataaagttgaggactttgaatctgggacagaactgcatcacctcactcccagagaaagttggtcagctctcccagctcactcagctggagctgaaggggaactgcttggaccgcctgccagcccagctgggccagtgtcggatgctcaagaaaagcgggcttgttgtggaagatcacctttttgataccctgccactcgaagtcaaagaggcattgaatcaagacataaatattccctttgcaaatgggatttaaactaagataatatatgcacagtgatgtgcaggaacaacttcctagattgcaagtgctcacgtacaagttattacaagataatgcattttaggagtagatacatcttttaaaataaaacagagaggatgcatagaaggctgatagaagacataactgaatgttcaatgtttgtagggttttaagtcattcatttccaaatcatttttttttttcttttggggaaagggaaggaaaaattataatcactaatcttggttctttttaaattgtttgtaacttggatgctgccgctactgaatgtttacaaattgcttgcctgctaaagtaaatgattaaattgacattttcttactata

SEQ ID NO: 455314 - DNA, 3746 bp, Homo sapiens
gcgtgggctcttgggagcgggacttctgctcaaatcctgtccaggggcttgaaaaggaggagaattgggggtggttgccgggaggaccagcacctccagttactggagggttgataggggccttctcctttccgtcaccctttactagggggtatcccttgcagataaatgagattttttgatttcttaaaaagccagctgcagtgaagaagaactgctgcaggtcgaggggaagagaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagcaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcccaaaacatgctcaaaagtagaacattttgtttcaatattaggaaagtgctttgaatccccttggacgacaaaagcgttgtctgagacagcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaatcctggataaaaaggatggagagcaggccaaagccctgtttgagaaagtgaggaagttccgtgcccatgtggaagatagtgacttgatctataaactctatgtggtccaaacagttatcaaaacagccaagttcatttttattctctgctatacagcgaactttgtcaacgcaatcagctttgaacacgtctgcaagcccaaagttgagcatctgattggttatgaggtatttgagtgcacccacaatatggcttacatgttgaaaaagcttctcatcagttacatatccattatttgtgtttatggctttatctgcctctacactctcttctggttattcaggatacctttgaaggaatattctttcgaaaaagtcagagaagagagcagttttagtgacattccagatgtcaaaaacgattttgcgttccttcttcacatggtagaccagtatgaccagctatattccaagcgttttggtgtgttcttgtcagaagttagtgaaaataaacttagggaaattagtttgaaccatgagtggacatttgaaaaactcaggcagcacatttcacgcaacgcccaggacaagcaggagttgcatctgttcatgctgtcgggggtgcccgatgctgtctttgacctcacagacctggatgtgctaaagcttgaactaattccagaagctaaaattcctgctaagatttctcaaatgactaacctccaagagctccacctctgccactgccctgcaaaagttgaacagactgcttttagctttcttcgcgatcacttgagatgccttcacgtgaagttcactgatgtggctgaaattcctgcctgggtgtatttgctcaaaaaccttcgagagttgtacttaataggcaatttgaactctgaaaacaataagatgataggacttgaatctctccgagagttgcggcaccttaagattctccacgtgaagagcaatttgaccaaagttccctccaacattacagatgtggctccacatcttacaaagttagtcattcataatgacggcactaaactcttggtactgaacagccttaagaaaatgatgaatgtcgctgagctggaactccagaactgtgagctagagagaatcccacatgctattttcagcctctctaatttacaggaactggatttaaagtccaataacattcgcacaattgaggaaatcatcagtttccagcatttaaaacgactgacttgtttaaaattatggcataacaaaattgttactattcctccctctattacccatgtcaaaaacttggagtcactttatttctctaacaacaagctcgaatccttaccagtggcagtatttagtttacagaaactcagatgcttagatgtgagctacaacaacatttcaatgattccaatagaaataggattgcttcagaacctgcagcatttgcatatcactgggaacaaagtggacattctgccaaaacaattgtttaaatgcataaagttgaggactttgaatctgggacagaactgcatcacctcactcccagagaaagttggtcagctctcccagctcactcagctggagctgaaggggaactgcttggaccgcctgccagcccagctgggccagtgtcggatgctcaagaaaagcgggcttgttgtggaagatcacctttttgataccctgccactcgaagtcaaagaggcattgaatcaagacataaatattccctttgcaaatgggatttaaactaagataatatatgcacagtgatgtgcaggaacaacttcctagattgcaagtgctcacgtacaagttattacaagataatgcattttaggagtagatacatcttttaaaataaaacagagaggatgcatagaaggctgatagaagacataactgaatgttcaatgtttgtagggttttaagtcattcatttccaaatcatttttttttttcttttggggaaagggaaggaaaaattataatcactaatcttggttctttttaaattgtttgtaacttggatgctgccgctactgaatgtttacaaattgcttgcctgctaaagtaaatgattaaattgacattttcttactatatcaccttttttgaggggtcttaatttactttgcttaattggtgcaatattgctttaactccgttcactaaagacaaacacatcaagtccaaacttgtaaatttagatttgctgaaatactgatttatttcctgttttaatttaaagtgcctcaagtaagcacctctcacaacagttgactggtactgctgctcctgagcacctcgtgtcatagattttatactcttacagacttggaatgcagtagaggtatgtggatttttaggggttttgtttttttaagaataagtaacaagaaataacacatttcttaataatagcttttttgacatagtttggagttctgattatatggtacatttttctaccagtaatatagggttgccaataaatagaaaatgttttctaaaaataaattttattacaaca

SEQ ID NO: 455315 - DNA, 2803 bp, Homo sapiens
gcgtgggctcttgggagcgggacttctgctcaaatcctgtccaggggcttgaaaaggaggagaattgggggtggttgccgggaggaccagcacctccagttactggagggttgataggggccttctcctttccgtcaccctttactagggggtatcccttgcagataaatgagattttttgatttcttaaaaagccagctgcagtgaagaagaactgctgcaggtcgaggggaagagaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagcaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcccaaaacatgctcaaaagtagaacattttgtttcaatattaggaaagtgctttgaatccccttggacgacaaaagcgttgtctgagacagcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaatcctggataaaaaggatggagagcaggccaaagccctgtttgagaaagtgaggaagttccgtgcccatgtggaagatagtgacttgatctataaactctatgtggtccaaacagttatcaaaacagccaagttcatttttattctctgctatacagcgaactttgtcaacgcaatcagctttgaacacgtctgcaagcccaaagttgagcatctgattggttatgaggtatttgagtgcacccacaatatggcttacatgttgaaaaagcttctcatcagttacatatccattatttgtgtttatggctttatctgcctctacactctcttctggttattcaggatacctttgaaggaatattctttcgaaaaagtcagagaagagagcagttttagtgacattccagatgtcaaaaacgattttgcgttccttcttcacatggtagaccagtatgaccagctatattccaagcgttttggtgtgttcttgtcagaagttagtgaaaataaacttagggaaattagtttgaaccatgagtggacatttgaaaaactcaggcagcacatttcacgcaacgcccaggacaagcaggagttgcatctgttcatgctgtcgggggtgcccgatgctgtctttgacctcacagacctggatgtgctaaagcttgaactaattccagaagctaaaattcctgctaagatttctcaaatgactaacctccaagagctccacctctgccactgccctgcaaaagttgaacagactgcttttagctttcttcgcgatcacttgagatgccttcacgtgaagttcactgatgtggctgaaattcctgcctgggtgtatttgctcaaaaaccttcgagagttgtacttaataggcaatttgaactctgaaaacaataagatgataggacttgaatctctccgagagttgcggcaccttaagattctccacgtgaagagcaatttgaccaaagttccctccaacattacagatgtggctccacatcttacaaagttagtcattcataatgacggcactaaactcttggtactgaacagccttaagaaaatgatgaatgtcgctgagctggaactccagaactgtgagctagagagaatcccacatgctattttcagcctctctaatttacaggaactggatttaaagtccaataacattcgcacaattgaggaaatcatcagtttccagcatttaaaacgactgacttgtttaaaattatggcataacaaaattgttactattcctccctctattacccatgtcaaaaacttggagtcactttatttctctaacaacaagctcgaatccttaccagtggcagtatttagtttacagaaactcagatgcttagatgtgagctacaacaacatttcaatgtttgtagggttttaagtcattcatttccaaatcatttttttttttcttttggggaaagggaaggaaaaattataatcactaatcttggttctttttaaattgtttgtaacttggatgctgccgctactgaatgtttacaaattgcttgcctgctaaagtaaatgattaaattgacattttcttactata

SEQ ID NO: 455316 - DNA, 819 bp, Homo sapiens
gggccaccggagaaagcgctcgcaatcacatggaggcccgggcccgccccattggctgcggccgggccagtcgcggcactcgccggctgcggttggtcccagagctgcagcgcctgcacgggcccggagtccatgttacgctttgtctaattcccctcgttacagagtcatgtgctgctgctcccgtcgccgctgtctgccgctgccgccgcccgtggtgccccggctcctccgccgcgcttcgaggtggcagccgcgggcggggccgcgggagcagggtccagggtgcagcgcgccttcgccgccccggcgcgtcccggtgcagccgccgcccgccgcgggtgatgccgccacctccggcctcagcataagccgtggcttggcggccgagctgcaccccaaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccacccctctacgtttccccaataaagccttttaaaaaaaccc

SEQ ID NO: 455317 - DNA, 198 bp, Homo sapiens
gcgtgggctcttgggagcgggacttctgctcaaatcctgtccaggggcttgaaaaggaggagaattgggggtggttgccgggaggaccagcacctccagttactggagggttgataggggccttctcctttccgtcaccctttactagggggtatcccttgcagataaatgagaaggcccctgagaggggtaccgagc

SEQ ID NO: 455318 - DNA, 4050 bp, Homo sapiens
ttgtaggaattcgcagtgtaggggaaatggtacagattttataatcaggaaagacctgtattcagttctccatttgaccactttctgccagagccatgggaacagttttttaatttctctgaccctgtttcctcacttgggaatatgacttttgcagatctgttggaaaatattaaggccaagagggatttaaaatgagatgttgtctagcactgagtaggagcttaatatctatccgttcctttctgcttcagtcaaaactgagcttcatatgtagaatgattattgtttgtattacattctccattttgagtatggaaccatgaatgccaacagcttgataataaaaggagccgtttgtcaagagacagtcctgtaagcgctttttaacctggtagactgtgcatgtaagggcaggcaggttacaaatgcgaatccccatagccagcacactctacatacagcagattcttaagccatctgtgtactctttttaacactgtactgaagtccacttaagtcagagttcaacaaaatgaatgaatgtaatcccaggactatggaacttctctgtgattacatagcacagagaactacggaatcattttctggaagaatgcaccatgcgattatgctccatgtggaattggtatatataaatgttggtagactgtgaggatgaggttgacaggttgatctgagtagagaccctaggaggaaccgaggatactatgtagttttgttgttgttactgttttgcagttcctggctgctctgtgttggcagctgtgtgcacgctttctcttttgagccagcgaggcacaagacaagtaatttcccatcttgaatctctcacagctgctgagctgtagtggatatactgggatgtggctatgaactttaaaaatttgcataaatccagcccctactcccctgcaaaggctcagtcttgtctttacaccttccccgaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagcaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcccaaaacatgctcaaaagtagaacattttgtttcaatattaggaaagtgctttgaatccccttggacgacaaaagcgttgtctgagacagcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaatcctggataaaaaggatggagagcaggccaaagccctgtttgagaaagtgaggaagttccgtgcccatgtggaagatagtgacttgatctataaactctatgtggtccaaacagttatcaaaacagccaagttcatttttattctctgctatacagcgaactttgtcaacgcaatcagctttgaacacgtctgcaagcccaaagttgagcatctgattggttatgaggtatttgagtgcacccacaatatggcttacatgttgaaaaagcttctcatcagttacatatccattatttgtgtttatggctttatctgcctctacactctcttctggttattcaggatacctttgaaggaatattctttcgaaaaagtcagagaagagagcagttttagtgacattccagatgtcaaaaacgattttgcgttccttcttcacatggtagaccagtatgaccagctatattccaagcgttttggtgtgttcttgtcagaagttagtgaaaataaacttagggaaattagtttgaaccatgagtggacatttgaaaaactcaggcagcacatttcacgcaacgcccaggacaagcaggagttgcatctgttcatgctgtcgggggtgcccgatgctgtctttgacctcacagacctggatgtgctaaagcttgaactaattccagaagctaaaattcctgctaagatttctcaaatgactaacctccaagagctccacctctgccactgccctgcaaaagttgaacagactgcttttagctttcttcgcgatcacttgagatgccttcacgtgaagttcactgatgtggctgaaattcctgcctgggtgtatttgctcaaaaaccttcgagagttgtacttaataggcaatttgaactctgaaaacaataagatgataggacttgaatctctccgagagttgcggcaccttaagattctccacgtgaagagcaatttgaccaaagttccctccaacattacagatgtggctccacatcttacaaagttagtcattcataatgacggcactaaactcttggtactgaacagccttaagaaaatgatgaatgtcgctgagctggaactccagaactgtgagctagagagaatcccacatgctattttcagcctctctaatttacaggaactggatttaaagtccaataacattcgcacaattgaggaaatcatcagtttccagcatttaaaacgactgacttgtttaaaattatggcataacaaaattgttactattcctccctctattacccatgtcaaaaacttggagtcactttatttctctaacaacaagctcgaatccttaccagtggcagtatttagtttacagaaactcagatgcttagatgtgagctacaacaacatttcaatgattccaatagaaataggattgcttcagaacctgcagcatttgcatatcactgggaacaaagtggacattctgccaaaacaattgtttaaatgcataaagttgaggactttgaatctgggacagaactgcatcacctcactcccagagaaagttggtcagctctcccagctcactcagctggagctgaaggggaactgcttggaccgcctgccagcccagctgggccagtgtcggatgctcaagaaaagcgggcttgttgtggaagatcacctttttgataccctgccactcgaagtcaaagaggcattgaatcaagacataaatattccctttgcaaatgggatttaaactaagataatatatgcacagtgatgtgcaggaacaacttcctagattgcaagtgctcacgtacaagttattacaagataatgcattttaggagtagatacatcttttaaaataaaacagagaggatgcatagaaggctgatagaagacataactgaatgttcaatgtttgtagggttttaagtcattcatttccaaatcatttttttttttcttttggggaaagggaaggaaaaattataatcactaatcttggttctttttaaattgtttgtaacttggatgctgccgctactgaatgtttacaaattgcttgcctgctaaagtaaatgattaaattgacattttcttactata

SEQ ID NO: 455319 - DNA, 3472 bp, Homo sapiens
cttctcaatccacatgctttccataggactgcatcaaaggccagagtttcagctatatatattgataaatcacaagtgtgtatagtaagactctggctaaacgctagacccttagtttcaactgttcatggacacttccaccagagtgattggagctaacgtaaacagctaacaaacacttgtggccagaggatgtgctaagagcgttacaatcattactttaatgagtccacaacaaatgccatcctgctgtcataccctccttcaaggtccactaagtaaccactatggacttggtgcagtctgtcataatttcttacctagaatgcaattcttactcattctttccctcttcccttgcactaggagagaaaagctgtatattccccttttagtttattttctactacatttatattggataaaaagataggacctgaatgagaaaactttagttaggagcaggcatagggtttttctcatttactcttttcatttgcatctctagaataatgtcttttgtcttcttgttttctaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagcaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcccaaaacatgctcaaaagtagaacattttgtttcaatattaggaaagtgctttgaatccccttggacgacaaaagcgttgtctgagacagcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaatcctggataaaaaggatggagagcaggccaaagccctgtttgagaaagtgaggaagttccgtgcccatgtggaagatagtgacttgatctataaactctatgtggtccaaacagttatcaaaacagccaagttcatttttattctctgctatacagcgaactttgtcaacgcaatcagctttgaacacgtctgcaagcccaaagttgagcatctgattggttatgaggtatttgagtgcacccacaatatggcttacatgttgaaaaagcttctcatcagttacatatccattatttgtgtttatggctttatctgcctctacactctcttctggttattcaggatacctttgaaggaatattctttcgaaaaagtcagagaagagagcagttttagtgacattccagatgtcaaaaacgattttgcgttccttcttcacatggtagaccagtatgaccagctatattccaagcgttttggtgtgttcttgtcagaagttagtgaaaataaacttagggaaattagtttgaaccatgagtggacatttgaaaaactcaggcagcacatttcacgcaacgcccaggacaagcaggagttgcatctgttcatgctgtcgggggtgcccgatgctgtctttgacctcacagacctggatgtgctaaagcttgaactaattccagaagctaaaattcctgctaagatttctcaaatgactaacctccaagagctccacctctgccactgccctgcaaaagttgaacagactgcttttagctttcttcgcgatcacttgagatgccttcacgtgaagttcactgatgtggctgaaattcctgcctgggtgtatttgctcaaaaaccttcgagagttgtacttaataggcaatttgaactctgaaaacaataagatgataggacttgaatctctccgagagttgcggcaccttaagattctccacgtgaagagcaatttgaccaaagttccctccaacattacagatgtggctccacatcttacaaagttagtcattcataatgacggcactaaactcttggtactgaacagccttaagaaaatgatgaatgtcgctgagctggaactccagaactgtgagctagagagaatcccacatgctattttcagcctctctaatttacaggaactggatttaaagtccaataacattcgcacaattgaggaaatcatcagtttccagcatttaaaacgactgacttgtttaaaattatggcataacaaaattgttactattcctccctctattacccatgtcaaaaacttggagtcactttatttctctaacaacaagctcgaatccttaccagtggcagtatttagtttacagaaactcagatgcttagatgtgagctacaacaacatttcaatgattccaatagaaataggattgcttcagaacctgcagcatttgcatatcactgggaacaaagtggacattctgccaaaacaattgtttaaatgcataaagttgaggactttgaatctgggacagaactgcatcacctcactcccagagaaagttggtcagctctcccagctcactcagctggagctgaaggggaactgcttggaccgcctgccagcccagctgggccagtgtcggatgctcaagaaaagcgggcttgttgtggaagatcacctttttgataccctgccactcgaagtcaaagaggcattgaatcaagacataaatattccctttgcaaatgggatttaaactaagataatatatgcacagtgatgtgcaggaacaacttcctagattgcaagtgctcacgtacaagttattacaagataatgcattttaggagtagatacatcttttaaaataaaacagagaggatgcatagaaggctgatagaagacataactgaatgttcaatgtttgtagggttttaagtcattcatttccaaatcatttttttttttcttttggggaaagggaaggaaaaattataatcactaatcttggttctttttaaattgtttgtaacttggatgctgccgctactgaatgtttacaaattgcttgcctgctaaagtaaatgattaaattgacattttcttactata

SEQ ID NO: 455320 - DNA, 3204 bp, Homo sapiens
gcgtgggctcttgggagcgggacttctgctcaaatcctgtccaggggcttgaaaaggaggagaattgggggtggttgccgggaggaccagcacctccagttactggagggttgataggggccttctcctttccgtcaccctttactagggggtatcccttgcagataaatgagattttttgatttcttaaaaagccagctgcagtgaagaagaactgctgcaggtcgaggggaagagaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagcaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcccaaaacatgctcaaaagtagaacattttgtttcaatattaggaaagtgctttgaatccccttggacgacaaaagcgttgtctgagacagcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaatcctggataaaaaggatggagagcaggccaaagccctgtttgagaaagtgaggaagttccgtgcccatgtggaagatagtgacttgatctataaactctatgtggtccaaacagttatcaaaacagccaagttcatttttattctctgctatacagcgaactttgtcaacgcaatcagctttgaacacgtctgcaagcccaaagttgagcatctgattggttatgaggtatttgagtgcacccacaatatggcttacatgttgaaaaagcttctcatcagttacatatccattatttgtgtttatggctttatctgcctctacactctcttctggttattcaggatacctttgaaggaatattctttcgaaaaagtcagagaagagagcagttttagtgacattccagatgtcaaaaacgattttgcgttccttcttcacatggtagaccagtatgaccagctatattccaagcgttttggtgtgttcttgtcagaagttagtgaaaataaacttagggaaattagtttgaaccatgagtggacatttgaaaaactcaggcagcacatttcacgcaacgcccaggacaagcaggagttgcatctgttcatgctgtcgggggtgcccgatgctgtctttgacctcacagacctggatgtgctaaagcttgaactaattccagaagctaaaattcctgctaagatttctcaaatgactaacctccaagagctccacctctgccactgccctgcaaaagttgaacagactgcttttagctttcttcgcgatcacttgagatgccttcacgtgaagttcactgatgtggctgaaattcctgcctgggtgtatttgctcaaaaaccttcgagagttgtacttaataggcaatttgaactctgaaaacaataagatgataggacttgaatctctccgagagttgcggcaccttaagattctccacgtgaagagcaatttgaccaaagttccctccaacattacagatgtggctccacatcttacaaagttagtcattcataatgacggcactaaactcttggtactgaacagccttaagaaaatgatgaatgtcgctgagctggaactccagaactgtgagctagagagaatcccacatgctattttcagcctctctaatttacaggaactggatttaaagtccaataacattcgcacaattgaggaaatcatcagtttccagcatttaaaacgactgacttgtttaaaattatggcataacaaaattgttactattcctccctctattacccatgtcaaaaacttggagtcactttatttctctaacaacaagctcgaatccttaccagtggcagtatttagtttacagaaactcagatgcttagatgtgagctacaacaacatttcaatgattccaatagaaataggattgcttcagaacctgcagcatttgcatatcactgggaacaaagtggacattctgccaaaacaattgtttaaatgcataaagttgaggactttgaatctgggacagaactgcatcacctcactcccagagaaagttggtcagctctcccagctcactcagctggagctgaaggggaactgcttggaccgcctgccagcccagctgggccagtgtcggatgctcaagaaaagcgggcttgttgtggaagatcacctttttgataccctgccactcgaagtcaaagaggcattgaatcaagacataaatattccctttgcatcttttaaaataaaacagagaggatgcatagaaggctgatagaagacataactgaatgttcaatgtttgtagggttttaagtcattcatttccaaatcatttttttttttcttttggggaaagggaaggaaaaattataatcactaatcttggttctttttaaattgtttgtaacttggatgctgccgctactgaatgtttacaaattgcttgcctgctaaagtaaatgattaaattgacattttcttactata

SEQ ID NO: 455321 - DNA, 2430 bp, Homo sapiens
  misc_feature (2227)..(2227): n is a, c, g, or t
gcgtgggctcttgggagcgggacttctgctcaaatcctgtccaggggcttgaaaaggaggagaattgggggtggttgccgggaggaccagcacctccagttactggagggttgataggggccttctcctttccgtcaccctttactagggggtatcccttgcagataaatgagattttttgatttcttaaaaagccagctgcagtgaagaagaactgctgcaggtcgaggggaagagaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagcaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcccaaaacatgctcaaaagtagaacattttgtttcaatattaggaaagtgctttgaatccccttggacgacaaaagcgttgtctgagacagcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaatcctggataaaaaggatggagagcaggccaaagccctgtttgagaaagtgaggaagttccgtgcccatgtggaagatagtgacttgatctataaactctatgtggtccaaacagttatcaaaacagccaagttcatttttattctctgctatacagcgaactttgtcaacgcaatcagctttgaacacgtctgcaagcccaaagttgagcatctgattggttatgaggtatttgagtgcacccacaatatggcttacatgttgaaaaagcttctcatcagttacatatccattatttgtgtttatggctttatctgcctctacactctcttctggttattcaggatacctttgaaggaatattctttcgaaaaagtcagagaagagagcagttttagtgacattccagatgtcaaaaacgattttgcgttccttcttcacatggtagaccagtatgaccagctatattccaagcgttttggtgtgttcttgtcagaagttagtgaaaataaacttagggaaattagtttgaaccatgagtggacatttgaaaaactcaggcagcacatttcacgcaacgcccaggacaagcaggagttgcatctgttcatgctgtcgggggtgcccgatgctgtctttgacctcacagacctggatgtgctaaagcttgaactaattccagaagctaaaattcctgctaagatttctcaaatgactaacctccaagagctccacctctgccactgccctgcaaaagttgaacagactgcttttagctttcttcgcgatcacttgagatgccttcacgtgaagttcactgatgtggctgaaattcctgcctgggtgtatttgctcaaaaaccttcgagagttgtacttaataggcaatttgaactctgaaaacaataagatgataggacttgaatctctccgagagttgcggcaccttaagattctccacgtgaagagcaatttgaccaaagttccctccaacattacagatgtgctcgtgccgattcgncacgagctcaatccccatcataatggtgggtccaggaaccgcatagccccgtttattgggttctacaacatagagagaaactccaagaacaacacccagatggaaattttggagcaatgtggttgttttttggctgcaggcataaggatagggattatctattcagaaaagagctcagacatttcctttaagcatgggatctt

SEQ ID NO: 455322 - DNA, 2624 bp, Homo sapiens
gaattaagatcttgtgtagacctgatttgtctggattttagagttatttgagagcccatatttcaccttgaggagggtgctgctgctgtgacagcctgcagtgttttgaaacagcatggattgggtgtcttgtttgcagcatgtgtcccatgttccccaacactgttgagggaaagctgttcctcaggacctgctgagtggccatattccctgaaggcctgaatctgtttcacaggccactgttggtaagatctaaagcatccagtagggaaacaaaattgataaatattgagtgtgagtaattgggattggggagattgtggcaaactagaggggaagtgcccattgtaaaaacacatccacagacagtccaggcactaaggctgaatgggatcagggtatccagaaatctcaggatctccagggccatgttactgttaggtcaaggtcactggtgcagcaacgaatgtagtttttctagattcctctccctccctgggctctttacctaatgtctttgcggcacaggcggtaaccctgggagtaaagaggtgtggtccaaggaagtagcttttgtgaccagctggagtttctggtgactcttttggcaatggtcctcattgtttgccagtttttcttactactgaggaagagattgtcttcccaagatatttggagtgataagagtcaccatagtgaggtagagtcactcttagtgatgtccagttgtccagtttccaatagaagtgggagatccagatttttaaatgggataactttttataggttcactgaggtgtaatcaacatgcaatatattgcacatatttaaagtgtacgagttaagtcttgatacacacacacacacacacacacacacacacacacacttgaaactatcaccctatcagtggtattggacatatctgttacccccaaagttaacctgaggcccttaacctttctctcagtgctcgccttcccccagaatccctaggcaaccactgagtagttttcactgtaggtaaatttgtcttttctagaattttatgtaagtctgcctataaagtgttaattttgcatgctgtctttcatgcaacataatttgaaatttgtccatggtatgtatgaacagtccattttaaaattactgagtcatattctgtatggatataccacagtttatccatttatcttaattgatgtctgtactccacccccatttttaaatattaaaaagctgctgcaaatattgatgcatgagtctttatgtggacacttagctgagaacatttttaagcagaggttttgaaggtgtgaccatatatcttactaattatagtaaaatatattggaaaagagatacatacagggaagaactgtgaaacagaaaagacctaagatttgatgatttgggaaattctcagcccatcttaattggaaaaaaaaaacaaaccattgaaattaagagattcattgttaggaaagatagatgttttagagagagagatgttttagagagatagccaaggatgtttgctgataccgggatcaaaacatacatcagaacactgtcacacaaaaagctctttgaagagattaaatgtgacttgtagatcccctcaatacaaacaatttataagaagtttaaactatcactcatctcagcaaaagccaaaaatatagataggggattccctaggaggaataatctgcataaacctcttttctaatgttgtgaatttcagtgatgtacaggagactcacaaaattcttgaaaattttataccagtggaaatgctcaccttgggtctaaagggaccttgaaagtatgaagttaaagggtgtaggcatgtaaagtgtgaagttaaaggttgtaatattctatacatgggactggctgcggaaacaggtgcaagcccttgctacctttcatgagaaaggaaggatgactcagagcagaggagagtccagtgggcagagtcctgaaccatgtgatattcccatgtcttgactcccagtggcatttgccaaactagatttcagattttcttgggattggtggttccattttttttgttttccccccttccatttcctccccttttgaaacaatgcatatacatataactattatcctaggtctttcccaaccttttgtttgggagcagataactagttttctagttttacagatccaaatgagacaggaatagcactgggtggtcacaggaggatggaaaatctcaacaccctggttttggtgcagctgaaaaaaaaaaagaaaaacccaaacaacagctaaaacgggaactaggcaaagaaaccgtgggataacagaaaacccaaaacaaaagagaaaactgccagaaccccagtcagggtgacatgtctgtaactcttccaggcaaacccaaataagggaggaggggtggtaatcaggggtccctgaaatcccctcttttcccagaatacctaatgattacccctattaaaggaacacccatacaattagaaacccaaactttgttttgcatgacttgctctcaggggcactcccacacttctctcttgtgtgtacttttgcttcacaataaaagctgcttgcctttgcttcacaaaaaa

SEQ ID NO: 455323 - DNA, 2327 bp, Homo sapiens
cctgtgacttacacctcagtagtacaacaacaaagcagaaaagggctgagtttatctgggatctgcacatggttctggattgctgaattgacccatgaaatagagccaggaggggaagatttaataggtggattcagggcaacccatggcagtgtggccgttgatcaggaccagatgtaatcctggatgcattatccaagcattctctggatgctgtgtgcagatttgcatgtggggaagccatggaggtaccagtgttgtgggtgtccatagatgtaaaggaggtatagccaaaagggtgactcttttggcaatggtcctcattgtttgccagtttttcttactactgaggaagagattgtcttcccaagatatttggagtgataagagtcaccatagtgaggtagagtcactcttagtgatgtccagttgtccagtttccaatagaagtgggagatccagatttttaaatgggataactttttataggttcactgaggtgtaatcaacatgcaatatattgcacatatttaaagtgtacgagttaagtcttgatacacacacacacacacacacacacacacacacacacttgaaactatcaccctatcagtggtattggacatatctgttacccccaaagttaacctgaggcccttaacctttctctcagtgctcgccttcccccagaatccctaggcaaccactgagtagttttcactgtaggtaaatttgtcttttctagaattttatgtaagtctgcctataaagtgttaattttgcatgctgtctttcatgcaacataatttgaaatttgtccatggtatgtatgaacagtccattttaaaattactgagtcatattctgtatggatataccacagtttatccatttatcttaattgatgtctgtactccacccccatttttaaatattaaaaagctgctgcaaatattgatgcatgagtctttatgtggacacttagctgagaacatttttaagcagaggttttgaaggtgtgaccatatatcttactaattatagtaaaatatattggaaaagagatacatacagggaagaactgtgaaacagaaaagacctaagatttgatgatttgggaaattctcagcccatcttaattggaaaaaaaaaacaaaccattgaaattaagagattcattgttaggaaagatagatgttttagagagagagatgttttagagagatagccaaggatgtttgctgataccgggatcaaaacatacatcagaacactgtcacacaaaaagctctttgaagagattaaatgtgacttgtagatcccctcaatacaaacaatttataagaagtttaaactatcactcatctcagcaaaagccaaaaatatagataggggattccctaggaggaataatctgcataaacctcttttctaatgttgtgaatttcagtgatgtacaggagactcacaaaattcttgaaaattttataccagtggaaatgctcaccttgggtctaaagggaccttgaaagtatgaagttaaagggtgtaggcatgtaaagtgtgaagttaaaggttgtaatattctatacatgggactggctgcggaaacaggtgcaagcccttgctacctttcatgagaaaggaaggatgactcagagcagaggagagtccagtgggcagagtcctgaaccatgtgatattcccatgtcttgactcccagtggcatttgccaaactagatttcagattttcttgggattggtggttccattttttttgttttccccccttccatttcctccccttttgaaacaatgcatatacatataactattatcctaggtctttcccaaccttttgtttgggagcagataactagttttctagttttacagatccaaatgagacaggaatagcactgggtggtcacaggaggatggaaaatctcaacaccctggttttggtgcagctgaaaaaaaaaaagaaaaacccaaacaacagctaaaacgggaactaggcaaagaaaccgtgggataacagaaaacccaaaacaaaagagaaaactgccagaaccccagtcagggtgacatgtctgtaactcttccaggcaaacccaaataagggaggaggggtggtaatcaggggtccctgaaatcccctcttttcccagaatacctaatgattacccctattaaaggaacacccatacaattagaaacccaaactttgttttgcatgacttgctctcaggggcactcccacacttctctcttgtgtgtacttttgcttcacaataaaagctgcttgcctttgcttcacaaaaaa

SEQ ID NO: 455324 - DNA, 2048 bp, Homo sapiens
ttatgagtggagctaggtctccagaatgaagcaggatacagagtttatggtttactcattagttagtcatgtgccagtcaatctgatgaaccagggtattctccactttagccacacattagagtcatctaggaagcttgagaaaatggcgatgcttgtgacttacacccaaagattctgatttaattggtctgaaatgtagactgggcattgggacttttgaaagctccccaggggtgattttaattgggagacaagattgagagccactcttgatacacacacacacacacacacacacacacacacacacttgaaactatcaccctatcagtggtattggacatatctgttacccccaaagttaacctgaggcccttaacctttctctcagtgctcgccttcccccagaatccctaggcaaccactgagtagttttcactgtaggtaaatttgtcttttctagaattttatgtaagtctgcctataaagtgttaattttgcatgctgtctttcatgcaacataatttgaaatttgtccatggtatgtatgaacagtccattttaaaattactgagtcatattctgtatggatataccacagtttatccatttatcttaattgatgtctgtactccacccccatttttaaatattaaaaagctgctgcaaatattgatgcatgagtctttatgtggacacttagctgagaacatttttaagcagaggttttgaaggtgtgaccatatatcttactaattatagtaaaatatattggaaaagagatacatacagggaagaactgtgaaacagaaaagacctaagatttgatgatttgggaaattctcagcccatcttaattggaaaaaaaaaacaaaccattgaaattaagagattcattgttaggaaagatagatgttttagagagagagatgttttagagagatagccaaggatgtttgctgataccgggatcaaaacatacatcagaacactgtcacacaaaaagctctttgaagagattaaatgtgacttgtagatcccctcaatacaaacaatttataagaagtttaaactatcactcatctcagcaaaagccaaaaatatagataggggattccctaggaggaataatctgcataaacctcttttctaatgttgtgaatttcagtgatgtacaggagactcacaaaattcttgaaaattttataccagtggaaatgctcaccttgggtctaaagggaccttgaaagtatgaagttaaagggtgtaggcatgtaaagtgtgaagttaaaggttgtaatattctatacatgggactggctgcggaaacaggtgcaagcccttgctacctttcatgagaaaggaaggatgactcagagcagaggagagtccagtgggcagagtcctgaaccatgtgatattcccatgtcttgactcccagtggcatttgccaaactagatttcagattttcttgggattggtggttccattttttttgttttccccccttccatttcctccccttttgaaacaatgcatatacatataactattatcctaggtctttcccaaccttttgtttgggagcagataactagttttctagttttacagatccaaatgagacaggaatagcactgggtggtcacaggaggatggaaaatctcaacaccctggttttggtgcagctgaaaaaaaaaaagaaaaacccaaacaacagctaaaacgggaactaggcaaagaaaccgtgggataacagaaaacccaaaacaaaagagaaaactgccagaaccccagtcagggtgacatgtctgtaactcttccaggcaaacccaaataagggaggaggggtggtaatcaggggtccctgaaatcccctcttttcccagaatacctaatgattacccctattaaaggaacacccatacaattagaaacccaaactttgttttgcatgacttgctctcaggggcactcccacacttctctcttgtgtgtacttttgcttcacaataaaagctgcttgcctttgcttcacaaaaaa

SEQ ID NO: 455325 - DNA, 4986 bp, Homo sapiens
gtggctgagaagaaggaggcctgagagcgacatgtccccggcggctcaggcggagcggccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagatttgagccctactaagtgactgaccactgtttagagtgtctagtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctcctcctgtggcccc

SEQ ID NO: 455326 - DNA, 4996 bp, Homo sapiens
gtggctgagaagaaggaggcctgagagcgacatgtccccggcggctcaggcggagcggccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaagcggggtactaatgacaactcccaaggtactgtgcactctgacatgcatggtctgggacacgtggatcgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagatttgagccctactaagtgactgaccactgtttagagtgtctagtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctcctcctgtggcccc

SEQ ID NO: 455327 - DNA, 4799 bp, Homo sapiens
gtggctgagaagaaggaggcctgagagcgacatgtccccggcggctcaggcggagcggccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagatttgagccctactaagtgactgaccactgtttagagtgtctagtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctcctcctgtggcccc

SEQ ID NO: 455328 - DNA, 1629 bp, Homo sapiens
gtggctgagaagaaggaggcctgagagcgacatgtccccggcggctcaggcggagcggccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgtgtgtgtgtgtgtaacagagagaggtagagagaggaggaagtggaggatgaggaggtagttgctctgttgtggaactcgaagacaccatcgataagcaagaccccataagagcaaagaccccaaaaga

SEQ ID NO: 455329 - DNA, 4751 bp, Homo sapiens
gtggctgagaagaaggaggcctgagagcgacatgtccccggcggctcaggcggagcggccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaagatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagatttgagccctactaagtgactgaccactgtttagagtgtctagtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctcctcctgtggcccc

SEQ ID NO: 455330 - DNA, 1178 bp, Homo sapiens
  misc_feature (1157)..(1157): n is a, c, g, or t
  misc_feature (1161)..(1161): n is a, c, g, or t
  misc_feature (1170)..(1171): n is a, c, g, or t
gtggctgagaagaaggaggcctgagagcgacatgtccccggcggctcaggcggagcggccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggttagttttttccatgattatgacaggcggtggggaaacaactcataagaaaataggccgttctacnagancaaaaaaanncctcggg

SEQ ID NO: 455331 - DNA, 1468 bp, Homo sapiens
tcttatgaagtatgatggatgtttttcctaggcaagtattggaagtcagtaaggatggtggctgtgccaaggggctgtgctctggctggtgctcagttgcaagaggagacagagaccgtttctgccctggcctccctaacagtggatgtggaacagccctttgctcaggaagacagcagaactgctggtgagcctatggaagaggagccagccttgtgaagtgccaagtccccctctgatatttcctgtgtgtgacatcattgtgtatccccccaccccagtaccctcagacatgtcttgtctgctgcctgggtggcacagattcaatggaacataaacactgggcacaaaattctgaacagcagcttcacttgttctttggatggacttgaaagggcattaaagattccttaaacgtaaccgctgtgattctagagttacagtaaaccacgattggaagaaactgcttccagcatgcttttaatatgctgggtgacccactcctagacaccaagtttgaactagaaacattcagtacagcactagatattgttaatttcagaagctatgacagccagtgaaattttgggcaaaacctgagacatagtcattcctgacattctgatcagctttttttggggtaatttgtttttcaaacagtcttaacttgtttacaagatttgcttttagctatgaacggatcgtaattccacccagaatgtaatgtttcttgtttgtttgttttgttttgttagggtttttttctcaactttaacacacagttcaactgttcctagtaaaagttcaagatggaggaactagcatgaggcttttttcagtatctcgaagtccaaatgccaaaggaacctcacacactgtttgtaatggtgcaatattttatatcacttttttttaaacatccccaacatctttgtgttctcacacacaggcaatttgcaatgttgcaattgtgttggagaatgaagtccccccacctcccagccacacacacatcctttgttctcatgacagtaggtctgagcaaatgttccaccaagcattttcagtgtctttgaaaagcacgtaacttttcaaaggtggtcttaatttgctgcatatctatcaaggacttattcactcacctttccttttctgccctctatcaattgatttcttcttacctttcatcattcattccttcctttagaaaaactgaagattacccataatctcctcttattacttgagggccttgactatttagtttattttgtttactttacaggttaacacagttgttttgtctgattgcattttattaactgtgaagccgttgaaatgaatatcacttaagcaacgttgctaaatttctatgtgtttgaaatgtgttaatgaaggcactgcttatttgtagtcaccttgaactgacttaacctagaagctgtgccttcttgtgaaaaaaaaaaaa

SEQ ID NO: 455332 - DNA, 781 bp, Homo sapiens
tgttgggaattattatggttacaggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgatggtgttcgatacttgctcaggtacagactttgtggagttgctctggtctgctctgccttctgccgtcctgctctgtagtaactaacactgaccatttaggcagtggctgggctgtcctttctgccctagtgaggagcagttctgggaggtctgttcggcctctgggtttatctaggcctaccctgtgtctcaggcccagcccaggagaggcagatactgggaatgatcctgcctttcagcaaggttcttctttgtgactgaataagctccttcctctggactgctggacaaccttgaacatcacgccttctacagcttagagcaggcttaattttttcctttgcccccaatattagcataattaatattaaaaaattagggtataattttgaacaaaaattaaagaaatacaaaaacctgtgaataagcagataccattttcactacttttttttttttgagacagaatcttgctgtattgtccaggctggaatgcagtcgtgtgaacatggctcactgtagcctcagcctcttcagctcaagcgatcctcctacctcagccaccatgcctggctaatt

SEQ ID NO: 455333 - DNA, 651 bp, Homo sapiens
tcgacccacgcgtccgcggacgcgtgggtcgcggacgcgtgggctcgaagacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttc

SEQ ID NO: 455334 - DNA, 2939 bp, Homo sapiens
agagcgattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgatggtgttcgatacttgctcaggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagaggtcgcctgtctcgtcccgaggccgtggctgaggtgaagagcttcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggaggacctcacaccgggcagcgtggaggaggctgaggaggctgagccagatgaagagtttaaagatgcgattgaggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgccctgctctgcctgggactgagcgagtggacttagggctgggcaggcagtagccaccagagggcagcagcgaactaggccaggcctgactggggtctgaagatcagggtcagtgtggctatgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttc

SEQ ID NO: 455335 - DNA, 2199 bp, Homo sapiens
gttagatctagaggatcccgagctctctctgttggggaatgtgatcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggaggacctcacaccgggcagcgtggaggaggctgaggaggctgagccagatgaagagtttaaagatgcgattgaggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgccctgctctgcctgggactgagcgagtggacttagggctgggcaggcagtagccaccagagggcagcagcgaactaggccaggcctgactggggtctgaagatcagggtcagtgtggctatgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttc

SEQ ID NO: 455336 - DNA, 2786 bp, Homo sapiens
agagcgattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgatggtgttcgatacttgctcaggtggcagatgcctttgtgttccttgctgacctgcctgggcctcaacgtcttgttcctcactttgaatgagggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagaggtcgcctgtctcgtcccgaggccgtggctgaggtgaagagcttcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggaggacctcacaccgggcagcgtggaggaggctgaggaggctgagccagatgaagagtttaaagatgcgattgaggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgccctgctctgcctgggactgagcgagtggacttagggctgggcaggcagtagccaccagagggcagcagcgaactaggccaggcctgactggggtctgaagatcagggtcagtgtggctatgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttc

SEQ ID NO: 455337 - DNA, 2765 bp, Homo sapiens
agagcgattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgatggtgttcgatacttgctcaggtggcagatgcctttgtgttccttgctgacctgcctgggcctcaacgtcttgttcctcactttgaatgagggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagaggtcgcctgtctcgtcccgaggccgtggctgaggtgaagagcttcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggaggacctcacaccgggcagcgtggaggaggctgaggaggctgagccagatgaagagtttaaagatgcgattgaggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgccctgctctgcctgggactgagcgagtggacttagggctgggcaggcagtagccaccagagggcagcagcgaactaggccaggcctgactggggtctgaagatcagggtcagtgtggctatgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctccgctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttc

SEQ ID NO: 455338 - DNA, 1863 bp, Homo sapiens
agagcgattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgatggtgttcgatacttgctcaggtggcagatgcctttgtgttccttgctgacctgcctgggcctcaacgtcttgttcctcactttgaatgagggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagaggtcgcctgtctcgtcccgaggccgtggctgaggtgaagagcttcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggaggacctcacaccgggcagcgtggaggaggctgaggaggctgagccagatgaagagtttaaagatgcgattgaggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcaaaatcctgaaacatttggtacatgccgaagaatagatatgatgtacctgtgaattgtgaagggtaataacaagatgaatacctgtggctgcttcactaaagttgaaaaacaagagccctggcaacacccccgcagctcccagcactgctcctgccttcctggagtcaatcaccagccgcaattttaatctttttcttatttccttggcactttgaacaaaactaaaaattcctttttttccttttataaaatataaaatatttcctatacatattgtaaataaaaaacacagataagcaaaaggaaaaaaaattcctgatttcttcctgagagaacaatcgggcatggaccctgctgctcattagcttgcatgtagaataaaagcacatgcatattcctgaaaaatgtggtcacatttcatgtaccgttttgtagtataatgttaaaccaagtttttttttttttttttttgagacggagtttcactcttgttgcccaggctggagtgcag

SEQ ID NO: 455339 - DNA, 956 bp, Homo sapiens
agagcgattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgatggtgttcgatacttgctcaggtacagactttgtggagttgctctggtctgctctgccttctgccgtcctgctctgtagtaactaacactgaccatttaggcagtggctgggctgtcctttctgccctagtgaggagcagttctgggaggtctgttcggcctctgggtttatctaggcctaccctgtgtctcaggcccagcccaggagaggcagatactgggaatgatcctgcctttcagcaaggttcttctttgtgactgaataagctccttcctctggactgctggacaaccttgaacatcacgccttctacagcttagagcaggcttaattttttcctttgcccccaatattagcataattaatattaaaaaattagggtataattttgaacaaaaattaaagaaatacaaaaacctgtgaataagcagataccattttcactacttttttttttttgagacagaatcttgctgtattgtccaggctggaatgcagtcgtgtgaacatggctcactgtagcctcagcctcttcagctcaagcgatcctcctacctcagccaccatgcctggctaatt

SEQ ID NO: 455340 - DNA, 3010 bp, Homo sapiens
agagcgattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgatggtgttcgatacttgctcaggtggcagatgcctttgtgttccttgctgacctgcctgggcctcaacgtcttgttcctcactttgaatgagggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagaggtcgcctgtctcgtcccgaggccgtggctgaggtgaagagcttcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggaggacctcacaccgggcagcgtggaggaggctgaggaggctgagccagatgaagagtttaaagatgcgattgaggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgccctgctctgcctgggactgagcgagtggacttagggctgggcaggcagtagccaccagagggcagcagcgaactaggccaggcctgactggggtctgaagatcagggtcagtgtggctatgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttc

SEQ ID NO: 455341 - DNA, 2825 bp, Homo sapiens
agagcgattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggtggcagatgcctttgtgttccttgctgacctgcctgggcctcaacgtcttgttcctcactttgaatgagggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagaggtcgcctgtctcgtcccgaggccgtggctgaggtgaagagcttctctctggtactccgactgtggagctcttctcgtgccgccgtgctgtggctgcatgttgtgacgccgactacccgggtgctggctgggagacccccggcgtgtctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggaggacctcacaccgggcagcgtggaggaggctgaggaggctgagccagatgaagagtttaaagatgcgattgaggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgccctgctctgcctgggactgagcgagtggacttagggctgggcaggcagtagccaccagagggcagcagcgaactaggccaggcctgactggggtctgaagatcagggtcagtgtggctatgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttc

SEQ ID NO: 455342 - DNA, 1851 bp, Homo sapiens
gagcaggtgagcgtgagagtcctgggatgggcgggggttgagctgctgcctctgtttctcagggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgccctgctctgcctgggactgagcgagtggacttagggctgggcaggcagtagccaccagagggcagcagcgaactaggccaggcctgactggggtctgaagatcagggtcagtgtggctatgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttc

SEQ ID NO: 455343 - DNA, 2233 bp, Homo sapiens
agagcgattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgatggtgttcgatacttgctcaggtggcagatgcctttgtgttccttgctgacctgcctgggcctcaacgtcttgttcctcactttgaatgagggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagaggtcgcctgtctcgtcccgaggccgtggctgaggtgaagagcttcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggaggacctcacaccgggcagcgtggaggaggctgaggaggctgagccagatgaagagtttaaagatgcgattgaggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgccctgctctgcctgggactgagcgagtggacttagggctgggcaggcagtagccaccagagggcagcagcgaactaggccaggcctgactggggtctgaagatcagggtcagtgtggctatgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaatggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttc

SEQ ID NO: 455344 - DNA, 1577 bp, Homo sapiens
agagcgattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgatggtgttcgatacttgctcaggtggcagatgcctttgtgttccttgctgacctgcctgggcctcaacgtcttgttcctcactttgaatgagggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagaggtcgcctgtctcgtcccgaggccgtggctgaggtgaagagcttcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggaggacctcacaccgggcagcgtggaggaggctgaggaggctgagccagatgaagagtttaaagatgcgattgaggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcggtgtgacaggagcaggcagttcttaagggttcagagcagccagattccagcagtgcccggtaacactacacacaagaagtattactctggtccagcaaataatttgtctatttctacaacttctaagtaaaggtacttagctgttcccattttacagatgagtaacctgaggtaaaaagagtgctttgcccagagactttggcctggaaatggtggagctgtgactcaaattcaggttgtctgattcggctcttgtcttctttctacctcttcatcctccctctctgttttccctttgcccttgcgtgtgaagtcccttgttttatgcctgtcccgcttttgtatttgatttttgg

SEQ ID NO: 455345 - DNA, 487 bp, Homo sapiens
agagcgattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggtaggtgaggtgccgtccccccgcgtcccagtgtctccgcaggctgtgtgtagttgggtgcttgggcgcagcgggggccgccacatgctggccccacgacctcgggcatggccttccctgtccagcctcacgggctccatcaggcccccctggctgcagaggtgttggccaaggccagtgcgggcgtcgatatacctcgccccttcctgggctcatacctggcgccgctctgtgccctttcgccttggctcggcctgcggggatttcggggtcccgttggcccctttg

SEQ ID NO: 455346 - DNA, 4458 bp, Homo sapiens
tgaggcgctttacggcgacggcggctgagtgagaaccttggcggctgtggaggctgccgcggctgcgaaggaggcggcggcggtggcggaggaagaggagtggcggcagcggcggcggggacccgtgcggggatggcggaggtaccgcctgggcctagcagcctcctcccaccaccagcacctccggccccggcggcggtcgagccccgctgtcccttcccggcgggggccgccctcgcctgctgcagcgaggacgaggaggacgacgaagagcacgaaggcggcggcagcaggagcccggcgggcggagagtcggcgacggtggcggccaaggggcatccgtgcctccgctgccctcagccgccgcaggagcagcagcagctcaacggattgattagccccgaactgcggcacctccgggcggccgcctccctcaagagcaaggtcctgagcgtagcagaggtggccgcgaccacagccacccctgacggaggccccagagcgactgcaacaaaaggagccggggtacactcgggcgagaggccccctcactccctctctagtaatgcaagaactgcggtccccagcccggtggaggcagcggcggcgagcgatcccgcggcggcccgcaatggactggccgagggcaccgagcaggaggaggaggaggaagacgagcaggtgcggctgctgtcttcgtccctgaccgccgactgcagcttaagaagcccttcgggcagggaggttgagcctggggaggatcggacgatacgatatgtccgatatgaatccgagctacaaatgcccgatatcatgagactgatcaccaaagatctgtccgaaccctactccatttatacctatagatattttatccacaactggccacagctgtgcttcttggccatggtaggggaggagtgtgtaggtgccatcgtttgcaagttggatatgcacaaaaagatgttccgcagaggttatatagccatgttagccgtggattccaaatacaggagaaatggcattggtactaacttggttaagaaagctatatatgccatggttgagggagactgtgatgaggttgttttggaaaccgaaataacaaataagtccgctttgaaactttatgaaaatcttggttttgttcgagataagaggctgttcagatactatttaaatggagttgatgcactgcgacttaaactgtggctgcgttgagaaactgacatcaaggaacaactatcatccacacagaatcgacctttgcatgcaatgcaatttgtacagaattgctttgcaggtggatttagtaatttccatgcagctcttacctgtcagtgtctcattgagtgtcgcacaatatttgttgcactttggcatggcacatttgttctgaattaaaagattgttttaaacttcaggagttcttttggtaccaacaagatgtgccagttgatagccaagatttatgtgttcatttgcaaagtctgctgacaatgttatttacacagtgatcattttatcacagaaccagtaagtggaacataatttttgttccctaaaaaagccaatgtggattgtaaaagtctttaagtatactaacatttcacacaaaacctgccctagttttctgaagtgggtgagggagacgcttcagttttaggttttattttttcaatattaaattttccattcttgaatattggtacctcagtgattagtgaatgaaaaaaatgtagggtgggtatgtcttacaatgagtaaaggtaacaattaaattttgtctgccagtgcctgtgtagataagtatatttgtcttcatctccagtttttgaatgcatgctatcttttccttttctttaaggcctttgcaagcaaacttttgtttttatttaaattctaaatttgataaattatttcagatttttataatttggatacttttttcaggtgaatgaaagaatggtttactttagaagtccctttttccttacagtaacaagttgaatctacttggaaaattgagaaatggctcaaaagagataagaaaagttgatggagccgggaattgctggggtttagatgcactttttcttttgagagtaagggaagttttggaaaagaatagaaaattagtgtaagttgatatgattttatttaatcaaaattactgctacgctgcgaagaacagcttttacaaagtagctgaatttgtttttcccacttgatttggattcacattgctttcatttcttaaaatgcttcacttcaggttcttggtcttggaaataaatttcaaggtgcattgtatccattttaagctgctttattttattttcacttgtatgagcaaattcttgggggagctttgcttttcttctgccagaaaaacaaaagggggaaatgaaaatcttttttggaatgagttctgtgggttttcttaacagccaccatgtttattagttacattgtgttttggccaatcagtgcaatgtaacaaattttacagttaattgctttcaattgagtcagtaaacctgtgatagataatttatttaactggaaaacctaggtacccataagaaaaaagattcattctctgtgaaaactgtaggaatctgttgttgttttcatttgaatatgctctacttctgctctagtatttggtttggaatatattttgtggctctaattactgtatttttaaaaaccctacctccattaacagttggtaaaggccccttttcaggaaagtttgttgcttttttttttttttaaaggaaagctgctctttgctcagtatagtgttttgaaagtgaacatagtaacaaatactttaaaaataaagatacacaatttatatttgaaaataaaaactttctgctggtgggattatttatagttctttatttttaaagaaaatgttttcctttttatattgctcttgaaagtttaatgagcagaatacaatactggttataataaaaatatggtaaccacacagtactcagcctttcaatatgtttttggtcaaacttcatttaggcactagcatttagaagaataccaatcacagtgatgcttttgttatttaatatgaaggaaatggaactaaaacatttatgtcatcaaattttatttcacttctttatatttgacttgctggttgatacataatggttgatgaacatatatttgcttaaatcactaatagggatggttgtaaagtagatagatcattggttcaaccattttagtgtttttgccagattgtcaatgaaaccatcatactgaccttttcctccaaaattgccaaattgactgaactggttgggtgtttgtaaagatgacgttaactgtgtgactaaaaagtcagatggttgccatattgtttggaatatgttgaatgtcagtgtatgccttatgtctttaattgggtatgcaaaaaaatttttacttaagtagattaaaattttaacctctagcatgaaaacccagcaccaacactgaaagactccattcaggttgaagtagcctcaaacagtaatttactttttgataataggctgttgtttttcttaaataagcttaaaacaattctatctgaaattggtagcatgggttcacttggctacaactgagcaaaatagatgcaactttcttttaatggggtgctgcctctttaggactgactgtactatccactgacactggtttggcagttggtactgctgaacatttttatacatgctaccatgaagctatatatgttagtattgaagaagctaacgggtatactatcatttttgatgtgtgggctgattataatttcctgtatttcctgtacattgggatgaaactactttagcaaagtccacagatcagaaaccagacggtagtttttgaagttgaaaccagcaaaataagaaaaaataaaaaatcgattttaatattttctgcctctttcccaaattacccttcccacttgctcgacaaatctatgtaaagcagtttgttttttcatgttttaactttaccttgccctgtgttatggtactggctgacatgtctaagactggatgtgtatatttattatggtgtctaaaaatcatgaagttcatcacttttcaggagtatagataaaatcaaattggtagtacatcagagttacttttcagtgcaccatgacatcactaaaatgagtgctgtaatgttacagggctttcaggtttgtaaaaacataaccataaattatattgacgtcagatatgagttgagtatctataaaatatcacgtgtatctcaaaatattggactgctgtttgactggatattgctgcataattttcttctattgtcccatatccttttggagagagatttaatgggatttgaaatgtgcaagctgtctaaataagatgcagtcaaataaagtatggttaagttgtgtttgca

SEQ ID NO: 455347 - DNA, 4129 bp, Homo sapiens
agcggggtcggcgacggtggcggagagtcagccgccgcaggagcagcagcagctcaacggattgattagccccgaactgcggcacctccgggcggccgcctccctcaagagcaaggtcctgagcgtagcagaggtggccgcgaccacagccacccctgacggaggccccagagcgactgcaacaaaaggagccggggtacactcgggcgagaggccccctcactccctctctagtaatgcaagaactgcggtccccagcccggtggaggcagcggcggcgagcgatcccgcggcggcccgcaatggactggccgagggcaccgagcaggaggaggaggaggaagacgagcaggtgcggctgctgtcttcgtccctgaccgccgactgcagcttaagaagcccttcgggcagggaggttgagcctggggaggatcggacgatacgatatgtccgatatgaatccgagctacaaatgcccgatatcatgagactgatcaccaaagatctgtccgaaccctactccatttatacctatagatattttatccacaactggccacagctgtgcttcttggccatggtaggggaggagtgtgtaggtgccatcgtttgcaagttggatatgcacaaaaagatgttccgcagaggttatatagccatgttagccgtggattccaaatacaggagaaatggcattggtactaacttggttaagaaagctatatatgccatggttgagggagactgtgatgaggttgttttggaaaccgaaataacaaataagtccgctttgaaactttatgaaaatcttggttttgttcgagataagaggctgttcagatactatttaaatggagttgatgcactgcgacttaaactgtggctgcgttgagaaactgacatcaaggaacaactatcatccacacagaatcgacctttgcatgcaatgcaatttgtacagaattgctttgcaggtggatttagtaatttccatgcagctcttacctgtcagtgtctcattgagtgtcgcacaatatttgttgcactttggcatggcacatttgttctgaattaaaagattgttttaaacttcaggagttcttttggtaccaacaagatgtgccagttgatagccaagatttatgtgttcatttgcaaagtctgctgacaatgttatttacacagtgatcattttatcacagaaccagtaagtggaacataatttttgttccctaaaaaagccaatgtggattgtaaaagtctttaagtatactaacatttcacacaaaacctgccctagttttctgaagtgggtgagggagacgcttcagttttaggttttattttttcaatattaaattttccattcttgaatattggtacctcagtgattagtgaatgaaaaaaatgtagggtgggtatgtcttacaatgagtaaaggtaacaattaaattttgtctgccagtgcctgtgtagataagtatatttgtcttcatctccagtttttgaatgcatgctatcttttccttttctttaaggcctttgcaagcaaacttttgtttttatttaaattctaaatttgataaattatttcagatttttataatttggatacttttttcaggtgaatgaaagaatggtttactttagaagtccctttttccttacagtaacaagttgaatctacttggaaaattgagaaatggctcaaaagagataagaaaagttgatggagccgggaattgctggggtttagatgcactttttcttttgagagtaagggaagttttggaaaagaatagaaaattagtgtaagttgatatgattttatttaatcaaaattactgctacgctgcgaagaacagcttttacaaagtagctgaatttgtttttcccacttgatttggattcacattgctttcatttcttaaaatgcttcacttcaggttcttggtcttggaaataaatttcaaggtgcattgtatccattttaagctgctttattttattttcacttgtatgagcaaattcttgggggagctttgcttttcttctgccagaaaaacaaaagggggaaatgaaaatcttttttggaatgagttctgtgggttttcttaacagccaccatgtttattagttacattgtgttttggccaatcagtgcaatgtaacaaattttacagttaattgctttcaattgagtcagtaaacctgtgatagataatttatttaactggaaaacctaggtacccataagaaaaaagattcattctctgtgaaaactgtaggaatctgttgttgttttcatttgaatatgctctacttctgctctagtatttggtttggaatatattttgtggctctaattactgtatttttaaaaaccctacctccattaacagttggtaaaggccccttttcaggaaagtttgttgcttttttttttttttaaaggaaagctgctctttgctcagtatagtgttttgaaagtgaacatagtaacaaatactttaaaaataaagatacacaatttatatttgaaaataaaaactttctgctggtgggattatttatagttctttatttttaaagaaaatgttttcctttttatattgctcttgaaagtttaatgagcagaatacaatactggttataataaaaatatggtaaccacacagtactcagcctttcaatatgtttttggtcaaacttcatttaggcactagcatttagaagaataccaatcacagtgatgcttttgttatttaatatgaaggaaatggaactaaaacatttatgtcatcaaattttatttcacttctttatatttgacttgctggttgatacataatggttgatgaacatatatttgcttaaatcactaatagggatggttgtaaagtagatagatcattggttcaaccattttagtgtttttgccagattgtcaatgaaaccatcatactgaccttttcctccaaaattgccaaattgactgaactggttgggtgtttgtaaagatgacgttaactgtgtgactaaaaagtcagatggttgccatattgtttggaatatgttgaatgtcagtgtatgccttatgtctttaattgggtatgcaaaaaaatttttacttaagtagattaaaattttaacctctagcatgaaaacccagcaccaacactgaaagactccattcaggttgaagtagcctcaaacagtaatttactttttgataataggctgttgtttttcttaaataagcttaaaacaattctatctgaaattggtagcatgggttcacttggctacaactgagcaaaatagatgcaactttcttttaatggggtgctgcctctttaggactgactgtactatccactgacactggtttggcagttggtactgctgaacatttttatacatgctaccatgaagctatatatgttagtattgaagaagctaacgggtatactatcatttttgatgtgtgggctgattataatttcctgtatttcctgtacattgggatgaaactactttagcaaagtccacagatcagaaaccagacggtagtttttgaagttgaaaccagcaaaataagaaaaaataaaaaatcgattttaatattttctgcctctttcccaaattacccttcccacttgctcgacaaatctatgtaaagcagtttgttttttcatgttttaactttaccttgccctgtgttatggtactggctgacatgtctaagactggatgtgtatatttattatggtgtctaaaaatcatgaagttcatcacttttcaggagtatagataaaatcaaattggtagtacatcagagttacttttcagtgcaccatgacatcactaaaatgagtgctgtaatgttacagggctttcaggtttgtaaaaacataaccataaattatattgacgtcagatatgagttgagtatctataaaatatcacgtgtatctcaaaatattggactgctgtttgactggatattgctgcataattttcttctattgtcccatatccttttggagagagatttaatgggatttgaaatgtgcaagctgtctaaataagatgcagtcaaataaagtatggttaagttgtgtttgca

SEQ ID NO: 455348 - DNA, 2825 bp, Homo sapiens
tgaggcgctttacggcgacggcggctgagtgagaaccttggcggctgtggaggctgccgcggctgcgaaggaggcggcggcggtggcggaggaagaggagtggcggcagcggcggcggggacccgtgcggggatggcggaggtaccgcctgggcctagcagcctcctcccaccaccagcacctccggccccggcggcggtcgagccccgctgtcccttcccggcgggggccgccctcgcctgctgcagcgaggacgaggaggacgacgaagagcacgaaggcggcggcagcaggagcccggcgggcggagagtcggcgacggtggcggccaaggggcatccgtgcctccgctgccctcagccgccgcaggagcagcagcagctcaacggattgattagccccgaactgcggcacctccgggcggccgcctccctcaagagcaaggtcctgagcgtagcagaggtggccgcgaccacagccacccctgacggaggccccagagcgactgcaacaaaaggagccggggtacactcgggcgagaggccccctcactccctctctagtaatgcaagaactgcggtccccagcccggtggaggcagcggcggcgagcgatcccgcggcggcccgcaatggactggccgagggcaccgagcaggaggaggaggaggaagacgagcaggtgcggctgctgtcttcgtccctgaccgccgactgcagcttaagaagcccttcgggcagggaggttgagcctggggaggatcggacgatacgatatgtccgatatgaatccgagctacaaatgcccgatatcatgagactgatcaccaaagatctgtccgaaccctactccatttatacctatagatattttatccacaactggccacagctgtgcttcttggccatggtaggggaggagtgtgtaggtgccatcgtttgcaagttggatatgcacaaaaagatgttccgcagaggttatatagccatgttagccgtggattccaaatacaggagaaatggcattggtactaacttggttaagaaagctatatatgccatggttgagggagactgtgatgaggttgttttggaaaccgaaataacaaataagtccgctttgaaactttatgaaaatcttggttttgttcgagataagaggctgttcagatactatttaaatggagttgatgcactgcgacttaaactgtggctgcgttgagaaactgacatcaaggaacaactatcatccacacagaatcgacctttgcatgcaatgcaatttgtacagaattgctttgcaggtggatttagtaatttccatgcagctcttacctgtcagtgtctcattgagtgtcgcacaatatttgttgcactttggcatggcacatttgttctgaattaaaagattgttttaaacttcaggagttcttttggtaccaacaagatgtgccagttgatagccaagatttatgtgttcatttgcaaagtctgctgacaatgttatttacacagtgatcattttatcacagaaccagtaagtggaacataatttttgttccctaaaaaagccaatgtggattgtaaaagtctttaagtatactaacatttcacacaaaacctgccctagttttctgaagtgggtgagggagacgcttcagttttaggttttattttttcaatattaaattttccattcttgaatattggtacctcagtgattagtgaatgaaaaaaatgtagggtgggtatgtcttacaatgagtaaaggtaacaattaaattttgtctgccagtgcctgtgtagataagtatatttgtcttcatctccagtttttgaatgcatgctatcttttccttttctttaaggcctttgcaagcaaacttttgtttttatttaaattctaaatttgataaattatttcagatttttataatttggatacttttttcaggtgaatgaaagaatggtttactttagaagtccctttttccttacagtaacaagttgaatctacttggaaaattgagaaatggctcaaaagagataagaaaagttgatggagccgggaattgctggggtttagatgcactttttcttttgagagtaagggaagttttggaaaagaatagaaaattagtgtaagttgatatgattttatttaatcaaaattactgctacgctgcgaagaacagcttttacaaagtagctgaatttgtttttcccacttgatttggattcacattgctttcatttcttaaaatgcttcacttcaggttcttggtcttggaaataaatttcaaggtgcattgtatccattttaagctgctttattttattttcacttgtatgagcaaattcttgggggagctttgcttttcttctgccagaaaaacaaaagggggaaatgaaaatcttttttggaatgagttctgtgggttttcttaacagccaccatgtttattagttacattgtgttttggccaatcagtgcaatgtaacaaattttacagttaattgctttcaattgagtcagtaaacctgtgatagataatttatttaactggaaaacctaggtacccataagaaaaaagattcattctctgtgaaaactgtaggaatctgttgttgttttcatttgaatatgctctacttctgctctagtatttggtttggaatatattcaaatgaaaacctaggtacccataagaaaaaagattcattctctgtgaaaactgtaggaatctgttgttgttttcatttgaatatgctctacttctgctctagtaattagagccacaaaatatattccaaaccaaatactag

SEQ ID NO: 455349 - DNA, 673 bp, Homo sapiens
gcgtagcagaggtggccgcgaccacagccacccctgacggaggccccagagcgactgcaacaaaaggagccggggtacactcgggcgagaggccccctcactccctctctagtaatgcaagaactgcggtccccagcccggtggaggcagcggcggcgagcgatcccgcggcggcccgcaatggactggccgagggcaccgagcaggaggaggaggaggaagacgagcaggtgcggctgctgtcttcgtccctgaccgccgactgcagcttaagaagcccttcgggcagggaggttgagcctggggaggatcggacgatacgatatgtccgatatgaatccgagctacaaatgcccgatatcatgagactgatcaccaaagatctgtccgaaccctactccatttatacctatagatattttatccacaactggccacagctgtgcttcttggtaagtggatagaataaaaagagggtgaacccagcagtgatcgagactgtgcggggcagggagtgagggcccagaatgtggcagtggatatctcctgctgcgtatcatagtacgttatatgatgtcaagtgctgtacacattcctagttatttaatgaaattgttttgaaggtaagacttcatgattcgggttaacgtgatactagtgtaactgcagcaag

SEQ ID NO: 455350 - DNA, 4540 bp, Homo sapiens
tgaggcgctttacggcgacggcggctgagtgagaaccttggcggctgtggaggctgccgcggctgcgaaggaggcggcggcggtggcggaggaagaggagtggcggcagcggcggcggggacccgtgcggggatggcggaggtaccgcctgggcctagcagcctcctcccaccaccagcacctccggccccggcggcggtcgagccccgctgtcccttcccggcgggggccgccctcgcctgctgcagcgaggacgaggaggacgacgaagagcacgaaggcggcggcagcaggagcccggcgggcggagagtcggcgacggtggcggccaaggggcatccgtgcctccgctgccctcagccgccgcaggagcagcagcagctcaacggattgattagccccgaactgcggcacctccgggcggccgcctccctcaagagcaaggtcctgagcgtagcagaggtggccgcgaccacagccacccctgacggaggccccagagcgactgcaacaaaaggagccggggtacactcgggcgagaggccccctcactccctctctagtaatgcaagaactgcggtccccagcccggtggaggcagcggcggcgagcgatcccgcggcggcccgcaatggactggccgagggcaccgagcaggaggaggaggaggaagacgagcaggtgcggctgctgtcttcgtccctgaccgccgactgcagcttaagaagcccttcgggcagggaggttgagcctggggaggatcggacgatacgatatgtccgatatgaatccgagctacaaatgcccgatatcatgagactgatcaccaaagatctgtccgaaccctactccatttatacctatagatattttatccacaactggccacagctgtgcttcttggccatggtaggggaggagtgtgtaggtgccatcgtttgcaagttggatatgcacaaaaagatgttccgcagaggttatatagccatgttagccgtggattccaaatacaggagaaatggcattggtactaacttggttaagaaagctatatatgccatggttgagggagactgtgatgaggttgttttggaaaccgaaataacaaataagtccgctttgaaactttatgaaaatcttggttttgttcgagataagaggctgttcagatactatttaaatggagttgatgcactgcgacttaaactgtggctgcgttgagaaactgacatcaaggaacaactatcatccacacagaatcgacctttgcatgcaatgcaatttgtacagaattgctttgcaggtggatttagtaatttccatgcagctcttacctgtcagtgtctcattgagtgtcgcacaatatttgttgcactttggcatggcacatttgttctgaattaaaagattgttttaaacttcaggagttcttttggtaccaacaagatgtgccagttgatagccaagatttatgtgttcatttgcaaagtctgctgacaatgttatttacacagtgatcattttatcacagaaccagtaagtggaacataatttttgttccctaaaaaagccaatgtggattgtaaaagtctttaagtatactaacatttcacacaaaacctgccctagttttctgaagtgggtgagggagacgcttcagttttaggttttattttttcaatattaaattttccattcttgaatattggtacctcagtgattagtgaatgaaaaaaatgtagggtgggtatgtcttacaatgagtaaaggtaacaattaaattttgtctgccagtgcctgtgtagataagtatatttgtcttcatctccagtttttgaatgcatgctatcttttccttttctttaaggcctttgcaagcaaacttttgtttttatttaaattctaaatttgataaattatttcagatttttataatttggatacttttttcaggtgaatgaaagaatggtttactttagaagtccctttttccttacagtaacaagttgaatctacttggaaaattgagaaatggctcaaaagagataagaaaagttgatggagccgggaattgctggggtttagatgcactttttcttttgagagtaagggaagttttggaaaagaatagaaaattagtgtaagttgatatgattttatttaatcaaaattactgctacgctgcgaagaacagcttttacaaagtagctgaatttgtttttcccacttgatttggattcacattgctttcatttcttaaaatgcttcacttcaggttcttggtcttggaaataaatttcaaggtgcattgtatccattttaagctgctttattttattttcacttgtatgagcaaattcttgggggagctttgcttttcttctgccagaaaaacaaaagggggaaatgaaaatcttttttggaatgagttctgtgggttttcttaacagccaccatgtttattagttacattgtgttttggccaatcagtgcaatgtaacaaattttacagttaattgctttcaattgagtcagtaaacctgtgatagataatttatttaactggaaaacctaggtacccataagaaaaaagattcattctctgtgaaaactgtaggaatctgttgttgttttcatttgaatatgctctacttctgctctagtatttggtttggaatatattttgtggctctaattactgtatttttaaaaaccctacctccattaacagttggtaaaggccccttttcaggaaagtttgttgcttttttttttttttaaaggaaagctgctctttgctcagtatagtgttttgaaagtgaacatagtaacaaatactttaaaaataaagatacacaatttatatttgaaaataaaaactttctgctggtgggattatttatagttctttatttttaaagaaaatgttttcctttttatattgctcttgaaagtttaatgagcagaatacaatactggttataataaaaatatggtaaccacacagtactcagcctttcaatatgtttttggtcaaacttcatttaggcactagcatttagaagaataccaatcacagtgatgcttttgttatttaatatgaaggaaatggaactaaaacatttatgtcatcaaattttatttcacttctttatatttgacttgctggttgatacataatggttgatgaacatatatttgcttaaatcactaatagggatggttgtaaagtagatagatcattggttcaaccattttagtgtttttgccagattgtcaatgaaaccatcatactgaccttttcctccaaaattgccaaattgactgaactggttgggtgtttgtaaagatgacgttaactgtgtgactaaaaagtcagatggttgccatattgtttggaatatgttgaatgtcagtgtatgccttatgtctttaattgggtatgcaaaaaaatttttacttaagtagattaaaattttaacctctagcatgaaaacccagcaccaacactgaaagactccattcaggttgaagtagcctcaaacagtaatttactttttgataataggctgttgtttttcttaaataagcttaaaacaattctatctgaaattggtagcatgggttcacttggctacaactgagcaaaatagatgcaactttcttttaatggggtgctgcctctttaggactgactgtactatccactgacactggtttggcagttggtactgctgaacatttttatacatgctaccatgaagctatatatgttagtattgaagaagctaacgggtatactatcatttttgatgtgtgggctgattataatttcctgtatttcctgtacattgggatgaaactactttagcaaagtccacagatcagaaaccagacggtagtttttgaagttgaaaccagcaaaataagaaaaaataaaaaatcgattttaatattttctgcctctttcccaaattacccttcccacttgctcgacaaatctatgtaaagcagtttgttttttcatgttttaactttaccttgccctgtgttatggtactggctgacatgtctaagactggatgtgtatatttattatggtgtctaaaaatcatgaagttcatcacttttcaggagtatagataaaatcaaattggtagtacatcagagttacttttcagtgcaccatgacatcactaaaatgagtgctgtaatgttacagggctttcaggtttgtaaaaacataaccataaattatattgacgtcagatatgagttgagtatctataaaatatcacgtgtatctcaaaatattggactgctgtttgactggatattgctgcataattttcttctattgtcccatatccttttggagagagatttaatgggatttgaaatgtgcaagctgtctaaataagatgcagtcaaataaagtatggttaagttgtgtttgcatttttcttttagatacagctgtgtgcattttatgattgggttgttttgcttttacctactaagtaaaacagcaacaaacaat

SEQ ID NO: 455351 - DNA, 1008 bp, Homo sapiens
tgaggcgctttacggcgacggcggctgagtgagaaccttggcggctgtggaggctgccgcggctgcgaaggaggcggcggcggtggcggaggaagaggagtggcggcagcggcggcggggacccgtgcggggatggcggaggtaccgcctgggcctagcagcctcctcccaccaccagcacctccggccccggcggcggtcgagccccgctgtcccttcccggcgggggccgccctcgcctgctgcagcgaggacgaggaggacgacgaagagcacgaaggcggcggcagcaggagcccggcgggcggagagtcggcgacggtggcggccaaggggcatccgtgcctccgctgccctcagccgccgcaggagcagcagcagctcaacggattgattagccccgaactgcggcacctccgggcggccgcctccctcaagagcaaggtcctgagcgtagcagaggtggccgcgaccacagccacccctgacggaggccccagagcgactgcaacaaaaggagccggggtacactcgggcgagaggccccctcactccctctctagtaatgcaagaactgcggtccccagcccggtggaggcagcggcggcgagcgatcccgcggcggcccgcaatggactggccgagggcaccgagcaggaggaggaggaggaagacgagcaggtgcggctgctgtcttcgtccctgaccgccgactgcagcttaagaagcccttcgggcagggaggttgagcctggggaggatcggacgatacgatatgtccgatatgaatccgagctacaaatgcccgatatcatgagactgatcaccaaagatctgtccgaaccctactccatttatacctatagatattttatccacaactggccacagctgtgcttcttggtcatggtaggggaggagtgttttctgtttctcttctctttttttacagcttttatctttacttaatacataatctaggttagtcactttttttcctatctgttc

SEQ ID NO: 455352 - DNA, 6274 bp, Homo sapiens
  misc_feature (3207)..(3207): n is a, c, g, or t
  misc_feature (3299)..(3299): n is a, c, g, or t
  misc_feature (3925)..(3925): n is a, c, g, or t
gcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgcctttggcacctgcctggccgcctccgtggctgcgcctggctctggcagggtgctatatgctgtcttcagcagagacagccggagcagtggggggcccggtgcgggcctctgcctgttcccgctggacaaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgacgggctcagaggcacagccgtgctgcagcgtggaggcctgaacctcacggccgtgacggtcgccgccgagaacaaccacactgttgcttttctgggcacctctgatggccggatcctcaaggtgtacctcaccccagatggcacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccagtgccgcgactcccaggacccctactgcggctggtgcgtcgtcgagggacgatgcacccggaaggccgagtgtccgcgggccgaggaggccagccactggctgtggagccgaagcaagtcctgcgtggccgtcaccagcgcccagccacagaacatgagccggcgggcccagggggaggtgcagctgaccgtcagccccctccctgccctgagcgaggaggacgagttgctgtgcctttttggggagtcgccgccacaccccgcccgcgtggagggcgaggccgtcatctgcaactccccaagcagcatccccgtcacaccgccaggccaggaccacgtggccgtgaccatccagctcctccttagacgaggcaacatcttcctcacgtcctaccagtaccccttctacgactgccgccaggccatgagcctggaggagaacctgccgtgcatctcctgcgtgagcaaccgctggacctgccagtgggacctgcgctaccacgagtgccgggaggcttcgcccaaccctgaggacggcatcgtccgtgcccacatggaggacagctgtccccagttcctgggacccagccccctggtgatccccatgaaccacgagacagatgtgaacttccagggcaagaacctggacaccgtgaagggttcctccctgcacgtgggcagtgacttgctcaagttcatggagccggtgaccatgcaggaatctgggaccttcgcctttcggaccccaaagctgtcccacgatgccaacgagacgctgcccctgcacctctacgtcaagtcttacggcaagaatatcgacagcaagctccatgtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccaggatccagcctgagacgggccccctgggtgggggcatccgcatcaccatcctggggtccaatttgggcgtccaagcaggggacatccagaggatctctgtggccggccggaactgctcctttcagccggaacgttactccgtgtccacccggatcgtgtgtgtgatcgaggctgcggagacgcctttcacggggggtgtcgaggtggacgtcttcgggaaactgggccgttcgcctcccaatgtccagttcaccttccaacagcccaagcctctcagtgtggagccgcagcagggaccgcaggcgggcggcaccacactgaccatccacggcacccacctggacacgggctcccaggaggacgtgcgggtgaccctcaacggcgtcccgtgtaaagtgacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccagtggtggccgcagcatcaacgtcacgggtcagggcttcagcctgatccagaggtttgccatggtggtcatcgcggagcccctgcagtcctggcagccgccgcgggaggctgaatccctgcagcccatgacggtggtgggtacagactacgtgttccacaatgacaccaaggtcgtcttcctgtccccggctgtgcctgaggagccagaggnctacaacctcacggtgctgatcgagatggacgggcaccgtgccctgctcagaacagaggccggggccttcgagtacgtgcctgaccccaccnttgagaacttcacaggtggcgtcaagaagcaggtcaacaagctcatccacgcccggggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgaagttcggctctcgcgagtgggtgctgggccgcgtggagtacgacacacgggtgagcgacgtgccgctcagcctcatcttgccgctggtcatcgtgcccatggtggtcgtcatcgcggtgtctgtctactgctactggaggaagagccagcaggccgaacgagagtatgagaagatcaagtcccagctggagggcctggaggagagcgtgcgggaccgctgcaagaaggaattcacagacctgatgatcgagatggaggaccagaccaacgacgtgcacgaggccggcatccccgtgctggactacaagacctacaccgaccgcgtcttcttcctgccctccaaggacggcgacaaggacgtgatgatcaccggcaagctggacatcccngagccgcggcggccggtggtggagcaggccctctaccagttctccaacctgctgaacagcaagtctttcctcatcaatttcatccacaccctggagaaccagcgggagttctcggcccgcgccaaggtctacttcgcgtccctgctgacggtggcgctgcacgggaaactggagtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgctggcccaggccagacagcgtggtcctggagtggcgtccgggctccacagcgcagatcctgtcggacctggacctgacgtcacagcgggagggccggtggaagcgcgtcaacacccttatgcactacaatgtccgggatggagccaccctcatcctgtccaaggtgggggtctcccagcagccggaggacagccagcaggacctgcctggggagcgccatgccctcctggaggaggagaaccgggtgtggcacctggtgcggccgaccgacgaggtggacgagggcaagtccaagagaggcagcgtgaaagagaaggagcggacgaaggccatcaccgagatctacctgacgcggctgctctcagtcaagggcacactgcagcagtttgtggacaacttcttccagagcgtgctggcgcctgggcacgcggtgccacctgcagtcaagtacttcttcgacttcctggacgagcaggcagagaagcacaacatccaggatgaagacaccatccacatctggaagacgaacagtttaccgctccggttctgggtgaacatcctcaagaacccccacttcatctttgacgtgcatgtccacgaggtggtggacgcctcgctgtcagtcatcgcgcagaccttcatggatgcctgcacgcgcacggagcataagctgagccgcgattctcccagcaacaagctgctgtacgccaaggagatctccacctacaagaagatggtggaggattactacaaggggatccggcagatggtgcaggtcagcgaccaggacatgaacacacacctggcagagatttcccgggcgcacacggactccttgaacaccctcgtggcactccaccagctctaccaatacacgcagaagtactatgacgagatcatcaatgccttggaggaggatcctgccgcccagaagatgcagctggccttccgcctgcagcagattgccgctgcactggagaacaaggtcactgacctctgacctacaatctccagtgctgccttgggacataggtacctgaggtacctgagagcccctcaggggaggaggccgagtggctgtggctgaggcccccaccctcccctggaacgcgccccaagccggagtgggtgcagccggaacccgcccagcgtctagactgtagcatcttcctctgagcaataccgccgggcaccgcaccagcaccagccccagccccagctccctccggccgcagaaccagcatcgggtgttcactgtcgagtctcgagtgatttgaaaatgtgccttacgctgccacgctgggggcagctggcctccgcctccgcccacgcaccagcagccgcctccatgccctaggttgggcccctgggggatctgagggcctgtggcccccagggcaagttcccagatcctatgtctgtctgtccaccacgagatgggaggaggagaaaaagcggtacgatgccttcctgacctcaccggcctccccaagggtgccggcactctgggtggactcacggctgctgggccccacgtcaaaggtcaagtgagacgtaggtcaagtcctacgtcggggcccagacatcctggggtcctggtctgtcagacaggctgccctagagccccacccagtccggggggactgggagcagttccaagaccaccccacccctttttgtaaatcttgttcattgtaaatcaaatacagcgtctttttcactccgcgggttggctgagtgttcctcc

SEQ ID NO: 455353 - DNA, 4000 bp, Homo sapiens
  misc_feature (3207)..(3207): n is a, c, g, or t
  misc_feature (3299)..(3299): n is a, c, g, or t
gcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgcctttggcacctgcctggccgcctccgtggctgcgcctggctctggcagggtgctatatgctgtcttcagcagagacagccggagcagtggggggcccggtgcgggcctctgcctgttcccgctggacaaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgacgggctcagaggcacagccgtgctgcagcgtggaggcctgaacctcacggccgtgacggtcgccgccgagaacaaccacactgttgcttttctgggcacctctgatggccggatcctcaaggtgtacctcaccccagatggcacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccagtgccgcgactcccaggacccctactgcggctggtgcgtcgtcgagggacgatgcacccggaaggccgagtgtccgcgggccgaggaggccagccactggctgtggagccgaagcaagtcctgcgtggccgtcaccagcgcccagccacagaacatgagccggcgggcccagggggaggtgcagctgaccgtcagccccctccctgccctgagcgaggaggacgagttgctgtgcctttttggggagtcgccgccacaccccgcccgcgtggagggcgaggccgtcatctgcaactccccaagcagcatccccgtcacaccgccaggccaggaccacgtggccgtgaccatccagctcctccttagacgaggcaacatcttcctcacgtcctaccagtaccccttctacgactgccgccaggccatgagcctggaggagaacctgccgtgcatctcctgcgtgagcaaccgctggacctgccagtgggacctgcgctaccacgagtgccgggaggcttcgcccaaccctgaggacggcatcgtccgtgcccacatggaggacagctgtccccagttcctgggacccagccccctggtgatccccatgaaccacgagacagatgtgaacttccagggcaagaacctggacaccgtgaagggttcctccctgcacgtgggcagtgacttgctcaagttcatggagccggtgaccatgcaggaatctgggaccttcgcctttcggaccccaaagctgtcccacgatgccaacgagacgctgcccctgcacctctacgtcaagtcttacggcaagaatatcgacagcaagctccatgtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccaggatccagcctgagacgggccccctgggtgggggcatccgcatcaccatcctggggtccaatttgggcgtccaagcaggggacatccagaggatctctgtggccggccggaactgctcctttcagccggaacgttactccgtgtccacccggatcgtgtgtgtgatcgaggctgcggagacgcctttcacggggggtgtcgaggtggacgtcttcgggaaactgggccgttcgcctcccaatgtccagttcaccttccaacagcccaagcctctcagtgtggagccgcagcagggaccgcaggcgggcggcaccacactgaccatccacggcacccacctggacacgggctcccaggaggacgtgcgggtgaccctcaacggcgtcccgtgtaaagtgacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccagtggtggccgcagcatcaacgtcacgggtcagggcttcagcctgatccagaggtttgccatggtggtcatcgcggagcccctgcagtcctggcagccgccgcgggaggctgaatccctgcagcccatgacggtggtgggtacagactacgtgttccacaatgacaccaaggtcgtcttcctgtccccggctgtgcctgaggagccagaggnctacaacctcacggtgctgatcgagatggacgggcaccgtgccctgctcagaacagaggccggggccttcgagtacgtgcctgaccccaccnttgagaacttcacaggtggcgtcaagaagcaggtcaacaagctcatccacgcccggggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgaagttcggctctcgcgagtgggtgctgggccgcgtggagtacgacacacgggtgagcgacgtgccgctcagcctcatcttgccgctggtcatcgtgcccatggtggtcgtcatcgcggtgtctgtctactgctactggaggaagagccagcaggccgaacgagagtatgagaagatcaagtcccagctggagggcctggaggagagcgtgcgggaccgctgcaagaaggaattcacagacctgatgatctgggtggactcacggctgctgggccccacgtcaaaggtcaagtgagacgtaggtcaagtcctacgtcggggcccagacatcctggggtcctggtctgtcagacaggctgccctagagccccacccagtccggggggactgggagcagttccaagaccaccccacccctttttgtaaatcttgttcattgtaaatcaaatacagcgtctttttcact

SEQ ID NO: 455354 - DNA, 6406 bp, Homo sapiens
  misc_feature (3207)..(3207): n is a, c, g, or t
  misc_feature (3299)..(3299): n is a, c, g, or t
  misc_feature (3925)..(3925): n is a, c, g, or t
gcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgcctttggcacctgcctggccgcctccgtggctgcgcctggctctggcagggtgctatatgctgtcttcagcagagacagccggagcagtggggggcccggtgcgggcctctgcctgttcccgctggacaaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgacgggctcagaggcacagccgtgctgcagcgtggaggcctgaacctcacggccgtgacggtcgccgccgagaacaaccacactgttgcttttctgggcacctctgatggccggatcctcaaggtgtacctcaccccagatggcacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccagtgccgcgactcccaggacccctactgcggctggtgcgtcgtcgagggacgatgcacccggaaggccgagtgtccgcgggccgaggaggccagccactggctgtggagccgaagcaagtcctgcgtggccgtcaccagcgcccagccacagaacatgagccggcgggcccagggggaggtgcagctgaccgtcagccccctccctgccctgagcgaggaggacgagttgctgtgcctttttggggagtcgccgccacaccccgcccgcgtggagggcgaggccgtcatctgcaactccccaagcagcatccccgtcacaccgccaggccaggaccacgtggccgtgaccatccagctcctccttagacgaggcaacatcttcctcacgtcctaccagtaccccttctacgactgccgccaggccatgagcctggaggagaacctgccgtgcatctcctgcgtgagcaaccgctggacctgccagtgggacctgcgctaccacgagtgccgggaggcttcgcccaaccctgaggacggcatcgtccgtgcccacatggaggacagctgtccccagttcctgggacccagccccctggtgatccccatgaaccacgagacagatgtgaacttccagggcaagaacctggacaccgtgaagggttcctccctgcacgtgggcagtgacttgctcaagttcatggagccggtgaccatgcaggaatctgggaccttcgcctttcggaccccaaagctgtcccacgatgccaacgagacgctgcccctgcacctctacgtcaagtcttacggcaagaatatcgacagcaagctccatgtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccaggatccagcctgagacgggccccctgggtgggggcatccgcatcaccatcctggggtccaatttgggcgtccaagcaggggacatccagaggatctctgtggccggccggaactgctcctttcagccggaacgttactccgtgtccacccggatcgtgtgtgtgatcgaggctgcggagacgcctttcacggggggtgtcgaggtggacgtcttcgggaaactgggccgttcgcctcccaatgtccagttcaccttccaacagcccaagcctctcagtgtggagccgcagcagggaccgcaggcgggcggcaccacactgaccatccacggcacccacctggacacgggctcccaggaggacgtgcgggtgaccctcaacggcgtcccgtgtaaagtgacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccagtggtggccgcagcatcaacgtcacgggtcagggcttcagcctgatccagaggtttgccatggtggtcatcgcggagcccctgcagtcctggcagccgccgcgggaggctgaatccctgcagcccatgacggtggtgggtacagactacgtgttccacaatgacaccaaggtcgtcttcctgtccccggctgtgcctgaggagccagaggnctacaacctcacggtgctgatcgagatggacgggcaccgtgccctgctcagaacagaggccggggccttcgagtacgtgcctgaccccaccnttgagaacttcacaggtggcgtcaagaagcaggtcaacaagctcatccacgcccggggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgaagttcggctctcgcgagtgggtgctgggccgcgtggagtacgacacacgggtgagcgacgtgccgctcagcctcatcttgccgctggtcatcgtgcccatggtggtcgtcatcgcggtgtctgtctactgctactggaggaagagccagcaggccgaacgagagtatgagaagatcaagtcccagctggagggcctggaggagagcgtgcgggaccgctgcaagaaggaattcacagacctgatgatcgagatggaggaccagaccaacgacgtgcacgaggccggcatccccgtgctggactacaagacctacaccgaccgcgtcttcttcctgccctccaaggacggcgacaaggacgtgatgatcaccggcaagctggacatcccngagccgcggcggccggtggtggagcaggccctctaccagttctccaacctgctgaacagcaagtctttcctcatcaatttcatccacaccctggagaaccagcgggagttctcggcccgcgccaaggtctacttcgcgtccctgctgacggtggcgctgcacgggaaactggagtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgctggcccaggccagacagcgtggtcctggagtggcgtccgggctccacagcgcagatcctgtcggacctggacctgacgtcacagcgggagggccggtggaagcgcgtcaacacccttatgcactacaatgtccgggatggagccaccctcatcctgtccaaggtgggggtctcccagcagccggaggacagccagcaggacctgcctggggagcgccatgccctcctggaggaggagaaccgggtgtggcacctggtgcggccgaccgacgaggtggacgagggcaagtccaagagaggcagcgtgaaagagaaggagcggacgaaggccatcaccgagatcctcctgcgtacagcagcttgttgctgggagaatcgcggctcagcttatgctccgtgcgcgtgcaggcatccatgaaggtctgcgcgatgactgacagcgaggcgtccaccacctcgtggacatgcacgtcaaagatgaagtgggggttcttgaggatgttcacccagaaccggagcggtaaactgttcgtcttccagatgtggatggtgtcttcatcctggatgttgtgcttctctgcctgctcgtccaggaagtcgaagaagtacttgactgcaggtggcaccgcgtgcccaggcagccagcacgctctggaagaagttgtccacaaactgctgcagtgtgcccttgactgagagcacccgcgtcaggtagatctcggtgatggccttcgtccgctccatctctatcacactgcctctcatggacatgccctcgtccacctcgtcggtcggccgcaccaggtgccacacccggttctcctcctccaggagggcatggcgctccccaggcaggtcctgctggctgtcctccggctgctgggagacccccaccttggacaggatgagggtggctccatcccggacattgtagtgcataagggtgttgacgcgctgccaccgtcccaccgctcgtgacgtcacgtccagtccgctctaccaatacacgcagaagtactatgacgagatcatcaatgccttggaggaggatcctgccgcccagaagatgcagctggccttccgcctgcagcagattgccgctgcactggagaacaaggtcactgacctctgacctacaatctccagtgctgccttgggacataggtacctgaggtacctgagagcccctcaggggaggaggccgagtggctgtggctgaggcccccaccctcccctggaacgcgccccaagccggagtgggtgcagccggaacccgcccagcgtctagactgtagcatcttcctctgagcaataccgccgggcaccgcaccagcaccagccccagccccagctccctccggccgcagaaccagcatcgggtgttcactgtcgagtctcgagtgatttgaaaatgtgccttacgctgccacgctgggggcagctggcctccgcctccgcccacgcaccagcagccgcctccatgccctaggttgggcccctgggggatctgagggcctgtggcccccagggcaagttcccagatcctatgtctgtctgtccaccacgagatgggaggaggagaaaaagcggtacgatgccttcctgacctcaccggcctccccaagggtgccggcactctgggtggactcacggctgctgggccccacgtcaaaggtcaagtgagacgtaggtcaagtcctacgtcggggcccagacatcctggggtcctggtctgtcagacaggctgccctagagccccacccagtccggggggactgggagcagttccaagaccaccccacccctttttgtaaatcttgttcattgtaaatcaaatacagcgtctttttcactccgcgggttggctgagtgttcctcc

SEQ ID NO: 455355 - DNA, 5052 bp, Homo sapiens
  misc_feature (3207)..(3207): n is a, c, g, or t
  misc_feature (3299)..(3299): n is a, c, g, or t
  misc_feature (3925)..(3925): n is a, c, g, or t
gcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgcctttggcacctgcctggccgcctccgtggctgcgcctggctctggcagggtgctatatgctgtcttcagcagagacagccggagcagtggggggcccggtgcgggcctctgcctgttcccgctggacaaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgacgggctcagaggcacagccgtgctgcagcgtggaggcctgaacctcacggccgtgacggtcgccgccgagaacaaccacactgttgcttttctgggcacctctgatggccggatcctcaaggtgtacctcaccccagatggcacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccagtgccgcgactcccaggacccctactgcggctggtgcgtcgtcgagggacgatgcacccggaaggccgagtgtccgcgggccgaggaggccagccactggctgtggagccgaagcaagtcctgcgtggccgtcaccagcgcccagccacagaacatgagccggcgggcccagggggaggtgcagctgaccgtcagccccctccctgccctgagcgaggaggacgagttgctgtgcctttttggggagtcgccgccacaccccgcccgcgtggagggcgaggccgtcatctgcaactccccaagcagcatccccgtcacaccgccaggccaggaccacgtggccgtgaccatccagctcctccttagacgaggcaacatcttcctcacgtcctaccagtaccccttctacgactgccgccaggccatgagcctggaggagaacctgccgtgcatctcctgcgtgagcaaccgctggacctgccagtgggacctgcgctaccacgagtgccgggaggcttcgcccaaccctgaggacggcatcgtccgtgcccacatggaggacagctgtccccagttcctgggacccagccccctggtgatccccatgaaccacgagacagatgtgaacttccagggcaagaacctggacaccgtgaagggttcctccctgcacgtgggcagtgacttgctcaagttcatggagccggtgaccatgcaggaatctgggaccttcgcctttcggaccccaaagctgtcccacgatgccaacgagacgctgcccctgcacctctacgtcaagtcttacggcaagaatatcgacagcaagctccatgtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccaggatccagcctgagacgggccccctgggtgggggcatccgcatcaccatcctggggtccaatttgggcgtccaagcaggggacatccagaggatctctgtggccggccggaactgctcctttcagccggaacgttactccgtgtccacccggatcgtgtgtgtgatcgaggctgcggagacgcctttcacggggggtgtcgaggtggacgtcttcgggaaactgggccgttcgcctcccaatgtccagttcaccttccaacagcccaagcctctcagtgtggagccgcagcagggaccgcaggcgggcggcaccacactgaccatccacggcacccacctggacacgggctcccaggaggacgtgcgggtgaccctcaacggcgtcccgtgtaaagtgacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccagtggtggccgcagcatcaacgtcacgggtcagggcttcagcctgatccagaggtttgccatggtggtcatcgcggagcccctgcagtcctggcagccgccgcgggaggctgaatccctgcagcccatgacggtggtgggtacagactacgtgttccacaatgacaccaaggtcgtcttcctgtccccggctgtgcctgaggagccagaggnctacaacctcacggtgctgatcgagatggacgggcaccgtgccctgctcagaacagaggccggggccttcgagtacgtgcctgaccccaccnttgagaacttcacaggtggcgtcaagaagcaggtcaacaagctcatccacgcccggggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgaagttcggctctcgcgagtgggtgctgggccgcgtggagtacgacacacgggtgagcgacgtgccgctcagcctcatcttgccgctggtcatcgtgcccatggtggtcgtcatcgcggtgtctgtctactgctactggaggaagagccagcaggccgaacgagagtatgagaagatcaagtcccagctggagggcctggaggagagcgtgcgggaccgctgcaagaaggaattcacagacctgatgatcgagatggaggaccagaccaacgacgtgcacgaggccggcatccccgtgctggactacaagacctacaccgaccgcgtcttcttcctgccctccaaggacggcgacaaggacgtgatgatcaccggcaagctggacatcccngagccgcggcggccggtggtggagcaggccctctaccagttctccaacctgctgaacagcaagtctttcctcatcaatttcatccacaccctggagaaccagcgggagttctcggcccgcgccaaggtctacttcgcgtccctgctgacggtggcgctgcacgggaaactggagtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgctggcccaggccagacagcgtggtcctggagtggcgtccgggctccacagcgcagatcctgtcggacctggacctgacgtcacagcgggagggccggtggaagcgcgtcaacacccttatgcactacaatgtccgggatggagccaccctcatcctgtccaaggtgggggtctcccagcagccggaggacagccagcagggcaagttcccagatcctatgtctgtctgtccaccacgagatgggaggaggagaaaaagcggtacgatgccttcctgacctcaccggcctccccaagggtgccggcactctgggtggactcacggctgctgggccccacgtcaaaggtcaagtgagacgtaggtcaagtcctacgtcggggcccagacatcctggggtcctggtctgtcagacaggctgccctagagccccacccagtccggggggactgggagcagttccaagaccaccccacccctttttgtaaatcttgttcattgtaaatcaaatacagcgtctttttcact

SEQ ID NO: 455356 - DNA, 6249 bp, Homo sapiens
  misc_feature (3207)..(3207): n is a, c, g, or t
  misc_feature (3299)..(3299): n is a, c, g, or t
  misc_feature (3925)..(3925): n is a, c, g, or t
gcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgcctttggcacctgcctggccgcctccgtggctgcgcctggctctggcagggtgctatatgctgtcttcagcagagacagccggagcagtggggggcccggtgcgggcctctgcctgttcccgctggacaaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgacgggctcagaggcacagccgtgctgcagcgtggaggcctgaacctcacggccgtgacggtcgccgccgagaacaaccacactgttgcttttctgggcacctctgatggccggatcctcaaggtgtacctcaccccagatggcacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccagtgccgcgactcccaggacccctactgcggctggtgcgtcgtcgagggacgatgcacccggaaggccgagtgtccgcgggccgaggaggccagccactggctgtggagccgaagcaagtcctgcgtggccgtcaccagcgcccagccacagaacatgagccggcgggcccagggggaggtgcagctgaccgtcagccccctccctgccctgagcgaggaggacgagttgctgtgcctttttggggagtcgccgccacaccccgcccgcgtggagggcgaggccgtcatctgcaactccccaagcagcatccccgtcacaccgccaggccaggaccacgtggccgtgaccatccagctcctccttagacgaggcaacatcttcctcacgtcctaccagtaccccttctacgactgccgccaggccatgagcctggaggagaacctgccgtgcatctcctgcgtgagcaaccgctggacctgccagtgggacctgcgctaccacgagtgccgggaggcttcgcccaaccctgaggacggcatcgtccgtgcccacatggaggacagctgtccccagttcctgggacccagccccctggtgatccccatgaaccacgagacagatgtgaacttccagggcaagaacctggacaccgtgaagggttcctccctgcacgtgggcagtgacttgctcaagttcatggagccggtgaccatgcaggaatctgggaccttcgcctttcggaccccaaagctgtcccacgatgccaacgagacgctgcccctgcacctctacgtcaagtcttacggcaagaatatcgacagcaagctccatgtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccaggatccagcctgagacgggccccctgggtgggggcatccgcatcaccatcctggggtccaatttgggcgtccaagcaggggacatccagaggatctctgtggccggccggaactgctcctttcagccggaacgttactccgtgtccacccggatcgtgtgtgtgatcgaggctgcggagacgcctttcacggggggtgtcgaggtggacgtcttcgggaaactgggccgttcgcctcccaatgtccagttcaccttccaacagcccaagcctctcagtgtggagccgcagcagggaccgcaggcgggcggcaccacactgaccatccacggcacccacctggacacgggctcccaggaggacgtgcgggtgaccctcaacggcgtcccgtgtaaagtgacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccagtggtggccgcagcatcaacgtcacgggtcagggcttcagcctgatccagaggtttgccatggtggtcatcgcggagcccctgcagtcctggcagccgccgcgggaggctgaatccctgcagcccatgacggtggtgggtacagactacgtgttccacaatgacaccaaggtcgtcttcctgtccccggctgtgcctgaggagccagaggnctacaacctcacggtgctgatcgagatggacgggcaccgtgccctgctcagaacagaggccggggccttcgagtacgtgcctgaccccaccnttgagaacttcacaggtggcgtcaagaagcaggtcaacaagctcatccacgcccggggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgaagttcggctctcgcgagtgggtgctgggccgcgtggagtacgacacacgggtgagcgacgtgccgctcagcctcatcttgccgctggtcatcgtgcccatggtggtcgtcatcgcggtgtctgtctactgctactggaggaagagccagcaggccgaacgagagtatgagaagatcaagtcccagctggagggcctggaggagagcgtgcgggaccgctgcaagaaggaattcacagacctgatgatcgagatggaggaccagaccaacgacgtgcacgaggccggcatccccgtgctggactacaagacctacaccgaccgcgtcttcttcctgccctccaaggacggcgacaaggacgtgatgatcaccggcaagctggacatcccngagccgcggcggccggtggtggagcaggccctctaccagttctccaacctgctgaacagcaagtctttcctcatcaatttcatccacaccctggagaaccagcgggagttctcggcccgcgccaaggtctacttcgcgtccctgctgacggtggcgctgcacgggaaactggagtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgctggcccaggccagacagcgtggtcctggagtggcgtccgggctccacagcgcagatcctgtcggacctggacctgacgtcacagcgggagggccggtggaagcgcgtcaacacccttatgcactacaatgtccgggatggagccaccctcatcctgtccaaggtgggggtctcccagcagccggaggacagccagcaggacctgcctggggagcgccatgccctcctggaggaggagaaccgggtgtggcacctggtgcggccgaccgacgaggtggacgagggcaagtccaagagaggcagcgtgaaagagaaggagcggacgaaggccatcaccgagatctacctgacgcggctgctctcagtcaagggcacactgcagcagtttgtggacaacttcttccagagcgtgctggcgcctgggcacgcggtgccacctgcagtcaagtacttcttcgacttcctggacgagcaggcagagaagcacaacatccaggatgaagacaccatccacatctggaagacgaacagtttaccgctccggttctgggtgaacatcctcaagaacccccacttcatctttgacgtgcatgtccacgaggtggtggacgcctcgctgtcagtcatcgcgcagaccttcatggatgcctgcacgcgcacggagcataagctgagccgcgattctcccagcaacaagctgctgtacgccaaggagatctccacctacaagaagatggtggaggattactacaaggggatccggcagatggtgcaggtcagcgaccaggacatgaacacacacctggcagagatttcccgggcgcacacggactccttgaacaccctcgtggcactccaccagctctaccaatacacgcagaagtactatgacgagatcatcaatgccttggaggaggatcctgccgcccagaagatgcagctggccttccgcctgcagcagattgccgctgcactggagaacaaggtcactgacctctgacctacaatctccagtgctgccttgggacataggtacctgaggtacctgagagcccctcaggggaggaggccgagtggctgtggctgaggcccccaccctcccctggaacgcgccccaagccggagtgggtgcagccggaacccgcccagcgtctagactgtagcatcttcctctgagcaataccgccgggcaccgcaccagcaccagccccagccccagctccctccggccgcagaaccagcatcgggtgttcactgtcgagtctcgagtgatttgaaaatgtgccttacgctgccacgctgggggcagctggcctccgcctccgcccacgcaccagcagccgcctccatgccctaggttgggcccctgggggatctgagggcctgtggcccccagggcaagttcccagatcctatgtctgtctgtccaccacgagatgggaggaggagaaaaagcggtacgatgccttcctgacctcaccggcctccccaagggtgccggcactctgggtggactcacggctgctgggccccacgtcaaaggtcaagtgagacgtaggtcaagtcctacgtcggggcccagacatcctggggtcctggtctgtcagacaggctgccctagagccccacccagtccggggggactgggagcagttccaagaccaccccacccctttttgtaaatcttgttcattgtaaatcaaatacagcgtctttttcact

SEQ ID NO: 455357 - DNA, 6270 bp, Homo sapiens
  misc_feature (3207)..(3207): n is a, c, g, or t
  misc_feature (3299)..(3299): n is a, c, g, or t
  misc_feature (3925)..(3925): n is a, c, g, or t
gcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgcctttggcacctgcctggccgcctccgtggctgcgcctggctctggcagggtgctatatgctgtcttcagcagagacagccggagcagtggggggcccggtgcgggcctctgcctgttcccgctggacaaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgacgggctcagaggcacagccgtgctgcagcgtggaggcctgaacctcacggccgtgacggtcgccgccgagaacaaccacactgttgcttttctgggcacctctgatggccggatcctcaaggtgtacctcaccccagatggcacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccagtgccgcgactcccaggacccctactgcggctggtgcgtcgtcgagggacgatgcacccggaaggccgagtgtccgcgggccgaggaggccagccactggctgtggagccgaagcaagtcctgcgtggccgtcaccagcgcccagccacagaacatgagccggcgggcccagggggaggtgcagctgaccgtcagccccctccctgccctgagcgaggaggacgagttgctgtgcctttttggggagtcgccgccacaccccgcccgcgtggagggcgaggccgtcatctgcaactccccaagcagcatccccgtcacaccgccaggccaggaccacgtggccgtgaccatccagctcctccttagacgaggcaacatcttcctcacgtcctaccagtaccccttctacgactgccgccaggccatgagcctggaggagaacctgccgtgcatctcctgcgtgagcaaccgctggacctgccagtgggacctgcgctaccacgagtgccgggaggcttcgcccaaccctgaggacggcatcgtccgtgcccacatggaggacagctgtccccagttcctgggacccagccccctggtgatccccatgaaccacgagacagatgtgaacttccagggcaagaacctggacaccgtgaagggttcctccctgcacgtgggcagtgacttgctcaagttcatggagccggtgaccatgcaggaatctgggaccttcgcctttcggaccccaaagctgtcccacgatgccaacgagacgctgcccctgcacctctacgtcaagtcttacggcaagaatatcgacagcaagctccatgtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccaggatccagcctgagacgggccccctgggtgggggcatccgcatcaccatcctggggtccaatttgggcgtccaagcaggggacatccagaggatctctgtggccggccggaactgctcctttcagccggaacgttactccgtgtccacccggatcgtgtgtgtgatcgaggctgcggagacgcctttcacggggggtgtcgaggtggacgtcttcgggaaactgggccgttcgcctcccaatgtccagttcaccttccaacagcccaagcctctcagtgtggagccgcagcagggaccgcaggcgggcggcaccacactgaccatccacggcacccacctggacacgggctcccaggaggacgtgcgggtgaccctcaacggcgtcccgtgtaaagtgacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccagtggtggccgcagcatcaacgtcacgggtcagggcttcagcctgatccagaggtttgccatggtggtcatcgcggagcccctgcagtcctggcagccgccgcgggaggctgaatccctgcagcccatgacggtggtgggtacagactacgtgttccacaatgacaccaaggtcgtcttcctgtccccggctgtgcctgaggagccagaggnctacaacctcacggtgctgatcgagatggacgggcaccgtgccctgctcagaacagaggccggggccttcgagtacgtgcctgaccccaccnttgagaacttcacaggtggcgtcaagaagcaggtcaacaagctcatccacgcccggggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgaagttcggctctcgcgagtgggtgctgggccgcgtggagtacgacacacgggtgagcgacgtgccgctcagcctcatcttgccgctggtcatcgtgcccatggtggtcgtcatcgcggtgtctgtctactgctactggaggaagagccagcaggccgaacgagagtatgagaagatcaagtcccagctggagggcctggaggagagcgtgcgggaccgctgcaagaaggaattcacagacctgatgatcgagatggaggaccagaccaacgacgtgcacgaggccggcatccccgtgctggactacaagacctacaccgaccgcgtcttcttcctgccctccaaggacggcgacaaggacgtgatgatcaccggcaagctggacatcccngagccgcggcggccggtggtggagcaggccctctaccagttctccaacctgctgaacagcaagtctttcctcatcaatttcatccacaccctggagaaccagcgggagttctcggcccgcgccaaggtctacttcgcgtccctgctgacggtggcgctgcacgggaaactggagtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgctggcccaggccagacagcgtggtcctggagtggcgtccgggctccacagcgcagatcctgtcggacctggacctgacgtcacagcgggagggccggtggaagcgcgtcaacacccttatgcactacaatgtccgggatggagccaccctcatcctgtccaaggtgggggtctcccagcagccggaggacagccagcaggacctgcctggggagcgccatgccctcctggaggaggagaaccgggtgtggcacctggtgcggccgaccgacgaggtggacgagggcaagtccaagagaggcagcgtgaaagagaaggagcggacgaaggccatcaccgagatctacctgacgcggctgctctcagtcaagggcacactgcagcagtttgtggacaacttcttccagagcgtgctggcgcctgggcacgcggtgccacctgcagtcaagtacttcttcgacttcctggacgagcaggcagagaagcacaacatccaggatgaagacaccatccacatctggaagacgaacagtttaccgctccggttctgggtgaacatcctcaagaacccccacttcatctttgacgtgcatgtccacgaggtggtggacgcctcgctgtcagtcatcgcgcagaccttcatggatgcctgcacgcgcacggagcataagctgagccgcgattctcccagcaacaagctgctgtacgccaaggagatctccacctacaagaagatggtggaggattactacaaggggatccggcagatggtgcaggtcagcgaccaggacatgaacacacacctggcagagatttcccgggcgcacacggactccttgaacaccctcgtggcactccaccagctctaccaatacacgcagaagtactatgacgagatcatcaatgccttggaggaggatcctgccgcccagaagatgcagctggccttccgcctgcagcagattgccgctgcactggagaacaaggtcactgacctctgacctacaatctccagtgctgccttgggacataggtacctgaggtacctgagagcccctcaggggaggaggccgagtggctgtggctgaggcccccaccctcccctggaacgcgccccaagccggagtgggtgcagccggaacccgcccagcgtctagactgtagcatcttcctctgagcaataccgccgggcaccgcaccagcaccagccccagccccagctccctccggccgcagaaccagcatcgggtgttcactgtcgagtctcgagtgatttgaaaatgtgccttacgctgccacgctgggggcagctggcctccgcctccgcccacgcaccagcagccgcctccatgccctaggttgggcccctgggggatctgagggcctgtggcccccagggcaagttcccagatcctatgtctgtctgtccaccacgagatgggaggaggagaaaaagcggtacgatgccttcctgacctcaccggcctccccaagggtgccggcactctgggtggactcacggctgctgggccccacgtcaaaggtcaagtgagacgtaggtcaagtcctacgtcggggcccagacatcctggggtcctggtctgtcagacaggctgccctagagccccacccagtccggggggactgggagcagttccaagaccaccccacccctttttgtaaatcttgttcattgtaaatcaaatacagcgtctttttcactagaaaaaaaatcacaaaaaaa

SEQ ID NO: 455358 - DNA, 4898 bp, Homo sapiens
  misc_feature (3207)..(3207): n is a, c, g, or t
  misc_feature (3299)..(3299): n is a, c, g, or t
  misc_feature (3925)..(3925): n is a, c, g, or t
gcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgcctttggcacctgcctggccgcctccgtggctgcgcctggctctggcagggtgctatatgctgtcttcagcagagacagccggagcagtggggggcccggtgcgggcctctgcctgttcccgctggacaaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgacgggctcagaggcacagccgtgctgcagcgtggaggcctgaacctcacggccgtgacggtcgccgccgagaacaaccacactgttgcttttctgggcacctctgatggccggatcctcaaggtgtacctcaccccagatggcacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccagtgccgcgactcccaggacccctactgcggctggtgcgtcgtcgagggacgatgcacccggaaggccgagtgtccgcgggccgaggaggccagccactggctgtggagccgaagcaagtcctgcgtggccgtcaccagcgcccagccacagaacatgagccggcgggcccagggggaggtgcagctgaccgtcagccccctccctgccctgagcgaggaggacgagttgctgtgcctttttggggagtcgccgccacaccccgcccgcgtggagggcgaggccgtcatctgcaactccccaagcagcatccccgtcacaccgccaggccaggaccacgtggccgtgaccatccagctcctccttagacgaggcaacatcttcctcacgtcctaccagtaccccttctacgactgccgccaggccatgagcctggaggagaacctgccgtgcatctcctgcgtgagcaaccgctggacctgccagtgggacctgcgctaccacgagtgccgggaggcttcgcccaaccctgaggacggcatcgtccgtgcccacatggaggacagctgtccccagttcctgggacccagccccctggtgatccccatgaaccacgagacagatgtgaacttccagggcaagaacctggacaccgtgaagggttcctccctgcacgtgggcagtgacttgctcaagttcatggagccggtgaccatgcaggaatctgggaccttcgcctttcggaccccaaagctgtcccacgatgccaacgagacgctgcccctgcacctctacgtcaagtcttacggcaagaatatcgacagcaagctccatgtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccaggatccagcctgagacgggccccctgggtgggggcatccgcatcaccatcctggggtccaatttgggcgtccaagcaggggacatccagaggatctctgtggccggccggaactgctcctttcagccggaacgttactccgtgtccacccggatcgtgtgtgtgatcgaggctgcggagacgcctttcacggggggtgtcgaggtggacgtcttcgggaaactgggccgttcgcctcccaatgtccagttcaccttccaacagcccaagcctctcagtgtggagccgcagcagggaccgcaggcgggcggcaccacactgaccatccacggcacccacctggacacgggctcccaggaggacgtgcgggtgaccctcaacggcgtcccgtgtaaagtgacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccagtggtggccgcagcatcaacgtcacgggtcagggcttcagcctgatccagaggtttgccatggtggtcatcgcggagcccctgcagtcctggcagccgccgcgggaggctgaatccctgcagcccatgacggtggtgggtacagactacgtgttccacaatgacaccaaggtcgtcttcctgtccccggctgtgcctgaggagccagaggnctacaacctcacggtgctgatcgagatggacgggcaccgtgccctgctcagaacagaggccggggccttcgagtacgtgcctgaccccaccnttgagaacttcacaggtggcgtcaagaagcaggtcaacaagctcatccacgcccggggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgaagttcggctctcgcgagtgggtgctgggccgcgtggagtacgacacacgggtgagcgacgtgccgctcagcctcatcttgccgctggtcatcgtgcccatggtggtcgtcatcgcggtgtctgtctactgctactggaggaagagccagcaggccgaacgagagtatgagaagatcaagtcccagctggagggcctggaggagagcgtgcgggaccgctgcaagaaggaattcacagacctgatgatcgagatggaggaccagaccaacgacgtgcacgaggccggcatccccgtgctggactacaagacctacaccgaccgcgtcttcttcctgccctccaaggacggcgacaaggacgtgatgatcaccggcaagctggacatcccngagccgcggcggccggtggtggagcaggccctctaccagttctccaacctgctgaacagcaagtctttcctcatcaatttcatccacaccctggagaaccagcgggagttctcggcccgcgccaaggtctacttcgcgtccctgctgacggtggcgctgcacgggaaactggagtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgctggcccaggccagacagcgtggtcctggagtggcgtccgggctccacagcgcagatcctgtcggacctggacctgacgtcacagcgggagggccggtggaagcgcgtcaacacccttatgcactacaatgtccgggatggagccatcccggtgaaggtcctcaactgtgacaccatctcccacgtcaaaggtcaagtgagacgtaggtcaagtcctacgtcggggcccagacatcctggggtcctggtctgtcagacaggctgccctagagccccacccagtccggggggactgggagcagttccaagaccaccccacccctttttgtaaatcttgttcattgtaaatcaaatacagcgtctttttcact

SEQ ID NO: 455359 - DNA, 796 bp, Homo sapiens
  misc_feature (754)..(755): n is a, c, g, or t
tagtcgttgtgacgccattcttctgcgacggcgcggacctggagcttccgcgcggtggcttcactctcctgtaaaacgctagagcggcgagttgttacctgcgtcctctgacctgagagcgaaggggaaagcggcgagatgactgaccgctacaccatccatagccagctggagcacctgcagtccaagtacatcggcacgggccacgccgacaccaccaagtgggagtggctggtgaaccaacaccgcgactcgtactgctcctacatgggccacttcgaccttctcaactacttcgccattgcggagaatgagagcaaagcgcgagtccgcttcaacttgatggaaaagatgcttcagccttgtggaccgccagccgacaagcccgaggagaactgagactctgccttaccaccgcagtgcggggcacctctcccagcgtttctccggtttgccaatcctcttaagtattcctgtctccaaaggaccggctctccatggctcctgcgcctcgtgctttccgcgtacagaagtgcttgcccggggagtcccgcctgacctgccttcatgtggacccttagaacagcactgggagaccagcaggactcctgagaactgtgctggtggagaggtcctagagccggcgagcgtttgagaagagggcatggcgctggagtgagatgggatttggcgtctcgtttttggctaattgattgtcattggctttttccataaagtttagaaatcggggagnnagcttttgttcggggccccattgctccttggccattcccct

SEQ ID NO: 455360 - DNA, 1088 bp, Homo sapiens
  misc_feature (362)..(362): n is a, c, g, or t
tccagaggatccacacacttcgatcgcggagaagacacctttgactgtgatacctgtgcaatgaccaccatgcatctcttgtttagggtagcttcatttataaaggtaaaagcactggttcttggcacttcagaagcctttagaattttcactcctaacagtgcaattaatgaaacaactgaacaggacctggaatattataaaagagaatagcgaaagattcttgacaggtcatgtgccttcaagtcctgttaatttgatgaatcagtaggagatgaaatcaatataaacctgaaggaattctcccacacttcgatcgcggagaatgagagcaaagcgcgagtccgcttcaacttgatggnaaagatgcttcagccttgtggaccgccagccgacaagcccgaggagaactgagactctgccttaccaccgcagtgcggggcacctctcccagcgtttctccggtttgccaatcctcttaagtattcctgtctccaaaggaccggctctccatggctccgcgactcgtactgctcctacatgggccacttcgaccttctcaactacttcgccattgcggagaatgagagcaaagcgcgagtccgcttcaacttgatggaaaagatgcttcagccttgtggaccgccagccgacaagcccgaggagaactgagactctgccttaccaccgcagtgcggggcacctctcccagcgtttctccggtttgccaatcctcttaagtattcctgtctccaaaggaccggctctccatggctcctgcgcctcgtgctttccgcgtacagaagtgcttgcccggggagtcccgcctgacctgccttcatgtggacccttagaacagcactgggagaccagcaggactcctgagaactgtgctggtggagaggtcctagagccggcgagcgtttgagaagagggcatggcgctggagtgagatgggatttggcgtctcgtttttggctaattgattgtcattggctttttccataaagtttagaaatcgttcagtctcttggtgtgaactttctgtgttagggtggaaggctccggaaagagctgagcgggaagtg

SEQ ID NO: 455361 - DNA, 790 bp, Homo sapiens
tagtcgttgtgacgccattcttctgcgacggcgcggacctggagcttccgcgcggtggcttcactctcctgtaaaacgctagagcggcgagttgttacctgcgtcctctgacctgagagcgaaggggaaagcggcgagatgactgaccgctacaccatccatagccagctggagcacctgcagtccaagtacatcggcacgggccacgccgacaccaccaagtgggagtggctggtgaaccaacaccgcgactcgtactgctcctacatgggccacttcgaccttctcaactacttcgccattgcggagaatgagagcaaagcgcgagtccgcttcaacttgatggaaaagatgcttcagccttgtggaccgccagccgacaagcccgaggagaactgagactctgccttaccaccgcagtgcggggcacctctcccagcgtttctccggtttgccaatcctcttaagtattcctgtctccaaaggaccggctctccatggctcctgcgcctcgtgctttccgcgtacagaagtgcttgcccggggagtcccgcctgacctgccttcatgtggacccttagaacagcactgggagaccagcaggactcctgagaactgtgctggtggagaggtcctagagccggcgagcgtttgagaagagggcatggcgctggagtgagatgggatttggcgtctcgtttttggctaattgattgtcattggctttttccataaagtttagaaaaacaaccaactcgaggcggggcccggacccttgcgctatgtgggt

SEQ ID NO: 455362 - DNA, 469 bp, Homo sapiens
gtggcccggagctgggtttgtcgcaaaacttatgtgacccgcgggagaactgagactctgccttaccaccgcagtgcggggcacctctcccagcgtttctccggtttgccaatcctcttaagtattcctgtctccaaaggaccggctctccatggctcctgcgcctcgtgctttccgcgtacagaagtgcttgcccggggagtcccgcctgacctgccttcatgtggacccttagaacagcactgggagaccagcaggactcctgagaactgtgctggtggagaggtcctagagccggcgagcgtttgagaagagggcatggcgctggagtgagatgggatttggcgtctcgtttttggctaattgattgtcattggctttttccataaagtttagaaatcgttcagtctcttggtgtgaactttctgtgttagggtggaaggctccggaaagagctgagcgggaagtg

SEQ ID NO: 455363 - DNA, 815 bp, Homo sapiens
tagtcgttgtgacgccattcttctgcgacggcgcggacctggagcttccgcgcggtggcttcactctcctgtaaaacgctagagcggcgagttgttacctgcgtcctctgacctgagagcgaaggggaaagcggcgagatgactgaccgctacaccatccatagccagctggagcacctgcagtccaagtacatcggcacgggccacgccgacaccaccaagtgggagtggctggtgaaccaacaccgcgactcgtactgctcctacatgggccacttcgaccttctcaactacttcgccattgcggagaatgagagcaaagcgcgagtccgcttcaacttgatggaaaagatgcttcagccttgtggaccgccagccgacaagcccgaggagaactgagactctgccttaccaccgcagtgcggggcacctctcccagcgtttctccggtttgccaatcctcttaagtattcctgtctccaaaggaccggctctccatggctcctgcgcctcgtgctttccgcgtacagaagtgcttgcccggggagtcccgcctgacctgccttcatgtggacccttagaacagcactgggagaccagcaggactcctgagaactgtgctggtggagaggtcctagagccggcgagcgtttgagaagagggcatggcgctggagtgagatgggatttggcgtctcgtttttggctaattgattgtcattggctttttccataaagtttagaaatcgttcagtctcttggtgtgaactttctgtgttagggtggaaggctccggaaagagctgagcgggaagtg

SEQ ID NO: 455364 - DNA, 761 bp, Homo sapiens
tagtcgttgtgacgccattcttctgcgacggcgcggacctggagcttccgcgcggtggcttcactctcctgtaaaacgctagagcggcgagttgttacctgcgtcctctgacctgagagcgaaggggaaagcggcgagatgactgaccgctacaccatccatagccagctggagcacctgcagtccaagtacatcggcacgggccacgccgacaccaccaagtgggagtggctggtgaaccaacaccgcgactcgtactgctcctacatgggccacttcgaccttctcaactacttcgccattgcggagaatgagagcaaagcgcgagtccgcttcaacttgatggactctgccttaccaccgcagtgcggggcacctctcccagcgtttctccggtttgccaatcctcttaagtattcctgtctccaaaggaccggctctccatggctcctgcgcctcgtgctttccgcgtacagaagtgcttgcccggggagtcccgcctgacctgccttcatgtggacccttagaacagcactgggagaccagcaggactcctgagaactgtgctggtggagaggtcctagagccggcgagcgtttgagaagagggcatggcgctggagtgagatgggatttggcgtctcgtttttggctaattgattgtcattggctttttccataaagtttagaaatcgttcagtctcttggtgtgaactttctgtgttagggtggaaggctccggaaagagctgagcgggaagtg

SEQ ID NO: 455365 - DNA, 4056 bp, Homo sapiens
gagaagcacctgaacgtgtccaagaagttccaccaggtcagcatcctgctggggatcgagctgctgtaccaagtgaacttcagcagggaggccctccaggagcgccgggcccgctgcgagacgcagaacattgaccccgtggtgtggaccaaccagcgggtgctcaagtgggttcgagacatcgacctgaaggagtacgcagacaacctgaccaacagcggcgtccatggtgctgtgctggtgctggagcccacattcaatgccgaggccatggccactgccctgggcatccccagtgggaagcacatcctccggagacacctggcagaggagatgagcgccgtcttccacccagccaactccacaggcatccgggaggctgagcgttttggaacgccccctggcagggcctccagcgtcacgcgggcaggaaaggaggagaacagcagcggtctcaagtacaaggctggccggctgcccctggggaagataggaaggggcttcagcagcaaagatcccgatttccatgatgactatggctctcttcaaaacgaagattgcggagacgatgacccccagagcaggctggaacagtgccgtctggaaggctacaacagcctggaggtcaccaacgtgtaaggaactggtggctccaccagacccaacgtgagagacccaggaaggaagagaagccagatggccccaggtgtcgttctcactgtacatagcggccgcaggctgaggatgtcccttgctcctgggcaaaatcccgatggactctgcggtttcagctccacagcgcccaggagagagaagacaccagcccacctgtcttgggtgggccatggactttcctgttcagctggagatgggcccagaggacctgtcacagtgtccggccctgcctccatccaggatacacaggctccacctcagagtgaccgtcactgtggagcagccaagcagtccctggagccttaaacggagctgccaaggtgggaagaggcccacagttccctaaaacacccttccggcgggagcaggggggaccccaaccccacaccccagcgcccagtgcattggcagagccgggtgcaggaagtgctgcctcttgccgagacgtcggacagggcgggggttggggaactctcggctacagcatcttacccttgactgagaacttgggtcctgacttggctcactgaatctctcttgggagaatgcaaaatccttccacctgaaaagctctgtgacacatgggggtggacgtattgaagagctgtttgccgatccacccaggagtggctacgctgagtggggagccggtgaatgatccgtgcaggagtggggcttagcagccacatttctaggagatgcagatatcctatcaccagaatgaaagctattgggacaacaggatcggggatgaccgatggccccatatggtgaatctctggcctgtggtttggctttactgagattccaaaccccactatctgcactccgtgacagtggtatggagtgtggcaatgagtctggggtctggggcagggaaatgcttgacattgttaacccaacaaacctttgttgtgatgtccctgtcacctgaaacataggtgacatagctcaccaatgtcctaaccgagacacaaactccacagagcaaaatcatttggtattgggtggggagaaccccagcccttttcttgacctgccactgttatgctgtgtggcttcttcccagtggcctcacctctctgtgcctcgatgtcttcatctacgatacttctggttccctcccagggacatcgtgaggattaacacttgctaatatctgtaacacaatttgtaacctctcaggagacaatgggaagttatggggtagctaatttcccatttacaacacagaaatgatatagagctagttcgctccaactctttaggttgaagcagtgtgcaaaaggaagaaaagaaatgtttaatgttcagacctgccaagagcctccaacagggctcaagaaacatataaatcccatgagcacagccttgaaaaccagtttgactcaagccttcgggcctcagttcattgaccagatgacagccacgtgatgattagggaaggacggatgcattgcgattctgcttacacatcgggttatcaaagcgagtcacttgttggaaccatgatgctcgacctccttcaaggccgtttgcactggggcttgagtttccaagattcacaacaggtgtcagcctctgagaaccctcaaagcgtgtgttcttcaacctggcaaattgtttcctctcatgggggaagccgagctctgatgaacttgagaattacacctctctcatgccgaagaccgtggtgttccccctaatgacataaacgcagcctttcttgctgtctgagaccaaatgtctagttggtagacaggtggatgtttggcctcctaagggcacacttctgatcctgggccccaggtggtgaatctctggcatgtggcttggctttgttgagactccaaattccattatcttcatgacattcggcctcatccatagggtcctgaagctgcagtccacagctcagaaaggagaggtgagacctccctccaacctggtgccacaggtctctcccaagccacatccagcctggatgacctgggaccccagaaactgccgtttgggaggcagcaacagcaacgtgcccaggcaggcagttattcccacagagtgagccagaattgtagcagggcacttgaatgcagagctgatgattttgaaaccaacgttcacccaacttgtcagaaatggcacttacatggttcgatcttgctggagacaagtggacaattgggggtcactggcagagacggtattgcccaaaatgttcacagcaggaggccagcaggcctgaggcaacacgggcaaccgcgaatgcctcttttggtttaaattatgccatcacaaccctctttcacccatgaggctccccatccctgacagccaggtgagcatttggagctggtttctcaacatgaggatgggttggttgttaaattaacaacctccacagtatcagattgagtgagctttgtctgctggaaaaacctgaaacgtcaactctgcttcaaggtcggcaagaagaacagaaggcggagacttggcagagagactcaagctgattgtcacaggctacagaggggccagctccagaacagtgaccagctacatcctgtccaagcagcccgagtgtggtcttggtccctgcagggcgatgtgggcatctggacctggggacgatgtggatgcacttcttggaaagctgttgtagcttgtgcctgtgggtggagaaggcacctgcctggtagactctcagctttctgacccccaggagcctctgcgaggcccctttgtccttggctgagccggacctttcttttggaaatctgtctgtctgttggcatcgctgttttcagaccccaggctgcagaggaggggagaagccacacaacaatctggacccaataaagtggagagaagggcgtctctacacagcccggccagcgtggagggccccaggacagggacccaaaagcttgacgtcactgaacagggctgggtactggcagaacaggaagatttggccagaggtgacctcagtgttccctccaggggcatccaggcccctctgacctggggagaagaaggcccatgctcaggcccacctccctcttcccatcagagcccatgcgtcctgggcaccaccacttccactctgcttttcgaggctccggagggctcttcctgctgtgaaaggaaaggagaagaaagcctgtgggcaatggcaacctctgagtctggcattcttgccaatggctggccagcgaggagaatctcccgagccctgacacacaaaggcattttgtggctgcagaggaaatgggttggctctgaacaaagatgcagtttctagggccgtggccccaaatcgcttccccgagagtgaattttaacactgtaacaataaatactactgcacagcaaaaaatg

SEQ ID NO: 455366 - DNA, 3679 bp, Homo sapiens
tcacagagcaattagaattggagacatttcccagaccttcattcttaattcttgtttctcttcttcctgtcctttgatcatattcttctcttctcagctgcccctggggaagataggaaggggcttcagcagcaaagatcccgatttccatgatgactatggctctcttcaaaacgaagattgcggagacgatgacccccagagcaggctggaacagtgccgtctggaaggctacaacagcctggaggtcaccaacgtgtaaggaactggtggctccaccagacccaacgtgagagacccaggaaggaagagaagccagatggccccaggtgtcgttctcactgtacatagcggccgcaggctgaggatgtcccttgctcctgggcaaaatcccgatggactctgcggtttcagctccacagcgcccaggagagagaagacaccagcccacctgtcttgggtgggccatggactttcctgttcagctggagatgggcccagaggacctgtcacagtgtccggccctgcctccatccaggatacacaggctccacctcagagtgaccgtcactgtggagcagccaagcagtccctggagccttaaacggagctgccaaggtgggaagaggcccacagttccctaaaacacccttccggcgggagcaggggggaccccaaccccacaccccagcgcccagtgcattggcagagccgggtgcaggaagtgctgcctcttgccgagacgtcggacagggcgggggttggggaactctcggctacagcatcttacccttgactgagaacttgggtcctgacttggctcactgaatctctcttgggagaatgcaaaatccttccacctgaaaagctctgtgacacatgggggtggacgtattgaagagctgtttgccgatccacccaggagtggctacgctgagtggggagccggtgaatgatccgtgcaggagtggggcttagcagccacatttctaggagatgcagatatcctatcaccagaatgaaagctattgggacaacaggatcggggatgaccgatggccccatatggtgaatctctggcctgtggtttggctttactgagattccaaaccccactatctgcactccgtgacagtggtatggagtgtggcaatgagtctggggtctggggcagggaaatgcttgacattgttaacccaacaaacctttgttgtgatgtccctgtcacctgaaacataggtgacatagctcaccaatgtcctaaccgagacacaaactccacagagcaaaatcatttggtattgggtggggagaaccccagcccttttcttgacctgccactgttatgctgtgtggcttcttcccagtggcctcacctctctgtgcctcgatgtcttcatctacgatacttctggttccctcccagggacatcgtgaggattaacacttgctaatatctgtaacacaatttgtaacctctcaggagacaatgggaagttatggggtagctaatttcccatttacaacacagaaatgatatagagctagttcgctccaactctttaggttgaagcagtgtgcaaaaggaagaaaagaaatgtttaatgttcagacctgccaagagcctccaacagggctcaagaaacatataaatcccatgagcacagccttgaaaaccagtttgactcaagccttcgggcctcagttcattgaccagatgacagccacgtgatgattagggaaggacggatgcattgcgattctgcttacacatcgggttatcaaagcgagtcacttgttggaaccatgatgctcgacctccttcaaggccgtttgcactggggcttgagtttccaagattcacaacaggtgtcagcctctgagaaccctcaaagcgtgtgttcttcaacctggcaaattgtttcctctcatgggggaagccgagctctgatgaacttgagaattacacctctctcatgccgaagaccgtggtgttccccctaatgacataaacgcagcctttcttgctgtctgagaccaaatgtctagttggtagacaggtggatgtttggcctcctaagggcacacttctgatcctgggccccaggtggtgaatctctggcatgtggcttggctttgttgagactccaaattccattatcttcatgacattcggcctcatccatagggtcctgaagctgcagtccacagctcagaaaggagaggtgagacctccctccaacctggtgccacaggtctctcccaagccacatccagcctggatgacctgggaccccagaaactgccgtttgggaggcagcaacagcaacgtgcccaggcaggcagttattcccacagagtgagccagaattgtagcagggcacttgaatgcagagctgatgattttgaaaccaacgttcacccaacttgtcagaaatggcacttacatggttcgatcttgctggagacaagtggacaattgggggtcactggcagagacggtattgcccaaaatgttcacagcaggaggccagcaggcctgaggcaacacgggcaaccgcgaatgcctcttttggtttaaattatgccatcacaaccctctttcacccatgaggctccccatccctgacagccaggtgagcatttggagctggtttctcaacatgaggatgggttggttgttaaattaacaacctccacagtatcagattgagtgagctttgtctgctggaaaaacctgaaacgtcaactctgcttcaaggtcggcaagaagaacagaaggcggagacttggcagagagactcaagctgattgtcacaggctacagaggggccagctccagaacagtgaccagctacatcctgtccaagcagcccgagtgtggtcttggtccctgcagggcgatgtgggcatctggacctggggacgatgtggatgcacttcttggaaagctgttgtagcttgtgcctgtgggtggagaaggcacctgcctggtagactctcagctttctgacccccaggagcctctgcgaggcccctttgtccttggctgagccggacctttcttttggaaatctgtctgtctgttggcatcgctgttttcagaccccaggctgcagaggaggggagaagccacacaacaatctggacccaataaagtggagagaagggcgtctctacacagcccggccagcgtggagggccccaggacagggacccaaaagcttgacgtcactgaacagggctgggtactggcagaacaggaagatttggccagaggtgacctcagtgttccctccaggggcatccaggcccctctgacctggggagaagaaggcccatgctcaggcccacctccctcttcccatcagagcccatgcgtcctgggcaccaccacttccactctgcttttcgaggctccggagggctcttcctgctgtgaaaggaaaggagaagaaagcctgtgggcaatggcaacctctgagtctggcattcttgccaatggctggccagcgaggagaatctcccgagccctgacacacaaaggcattttgtggctgcagaggaaatgggttggctctgaacaaagatgcagtttctagggccgtggccccaaatcgcttccccgagagtgaattttaacactgtaacaataaatactactgcacagcaaaaaatg

SEQ ID NO: 455367 - DNA, 713 bp, Homo sapiens
ttttttcacctaaggaagacatttctaccacttagagctgttcagagagctgaaacaggctgcttgggagaccatagctctccttccccggaaatggtcaggcagagactgtaattccaatgtcagggagggattgaataaaatgacctccaacgtgccttccagcctaagaagtctggaatctttgcaggaatgtgagatggttctgggggctggagtttgcctttgattctgactgctctcttttgtctcacatttttcagctgcatttggctgctctgaacatgccattttctggggacattcgagctgattttcagtgcttcaagcaggccagagctgcaggactgttgtccacctaccgagcattcttatcttcccatttgcaagatctgtccaccattgtgaggaaagcagagagatacagccttcccatagtgaacctcaaggtaaaaataaatatggttcccattgccttctgcatgcattggtcgctacagggcctggaggcagttttcattcctgacatcaacagaagactgttgacttaagcctgctctctcccttactggctatgtcactttgggtgggttctttgccttccctgaacctcagttttctttatgcttgtgtgacccttgaagcatgcaggaggagagatagtgataacttctttcattgatacagggtattaagctcatggtgctagctct

SEQ ID NO: 455368 - DNA, 5620 bp, Homo sapiens
ggagtcgggtttcagagcgcgggtgactcggggcgcgggccgggagccgggattctgcccgccgccgccgctgccgagcgccgcctttgttccctgcaggaagggcgagcgcggcggccagcgctcagcgacccttcgtcctccgctaagctccaacgctctgctcgactagccgcgcgccttccggggctccgcagacccgcgagatggcaccaaggaggaacaacgggcagtgctggtgtctgctgatgctgctctcggtctccacgcccctccctgctgtcacccagacccgcggtgcgacagagactgcttcccagggtcacctggacctcacgcagctcatcggtgtcccgctgccctcgtccgtatcctttgtcacaggctatggtggcttcccggcctacagtttcgggcctggtgccaatgttggccgcccagccaggactctcatcccatccaccttcttcagggacttcgccatcaggctcgtggtgaagcccagcagcacccgtggtggcgtgctcttcgccatcactgacgccttccagaaggtcatctacctgggcctgcggctctcaggtgtggaggacggccaccagcggatcatcctctactacacggagccaggctcccatgtgtcccaagaggctgctgccttctcggtgcctgtgatgacccacaggtggaaccgcttcgccatgattgtccagggtgaggaagtgaccctcctcgtgaactgtgaggagcacagccgcatccccttccagcggtcctcccaggctttggcttttgagtccagcgctggaatcttcatgggcaatgcaggagctacagggctcgagagattcactggctccctccagcagctcaccgtgcaccccgaccccaggactcccgaggagctgtgtgaccctgaagagtcctcggcatctggagagaccagtgggctgcaggaggcagacggagtagctgagatcttagaagccgtcacctacactcaagcctcgcccaaagaagcaaaagttgaacccataaacacacctccaactccatcctccccctttgaagacatggaactttctggtgaacctgtacccgaggggaccctggaaaccaccaacatgagcatcatccagcacagcagccccaaacaagggtctggtgagatcctgaatgacacactggagggggttcattctgtggatggtgaccccattactgacagcggctcaggggctggggccttccttgacattgctgaagaaaagaatttagcagcaacagcagcggggctggccgaggtgcccatcagcactgctggagaagcagaggccagcagtgtgcccaccgggggaccaaccctctctatgtccacggagaacccagaggaaggggtcactccaggtccagataatgaagagcgtttacgcagcaacagcagcaggggaggccgaggcactcgccagcatgcctggggaagtggaggccagtggtgtggcccccggggagctggacctctccatgtccgcccagagcctcggggaagaggccactgtgggtccaagcagtgaagacagtttaacaacagctgcagctgcaaccgaagtgtccctcagtacttttgaggatgaggaagccagtggggtccccacagatggcctggctcccctcacagccaccatggcccctgagcgggcagtcacttctggtcctggtgatgaagaagacttggcagcagccacaacagaggagcccctcatcacagctgggggtgaagagtccggcagccctccccctgatgggccaccgctgcccctgcccacagtggctcctgaaagatggatcactccagctcaaagagaacatgtgggaatgaaaggacaggctgggcccaaaggagaaaagggtgatgctggggaggagcttcctggccctcctgaaccttctgggcctgttggacccacggcaggagcagaagcagagggctctggcctaggctggggctcggacgtcggctctggctctggtgacctggtgggcagtgagcagctgctgagaggtcctccaggacccccagggccacctggcttacctgggattccaggaaaaccaggaactgatgttttcatgggaccccctggatctcctggagaggatggacctgctggtgaacctgggcccccgggccctgagggacagcctggagttgatggagccaccggccttcccgggatgaaaggggagaagggagcaagagggcctaatggctcagttggtgaaaagggtgaccctggcaacagaggcttacctggacccccggggaaaaagggacaagctggccctcctggggtcatgggacccccagggcctcctggaccccctgggcccccaggccctggatgcacaatgggacttggattcgaggataccgaaggctctggaagcacccagctattgaatgaacccaaactctccagaccaacggctgcaattggtctcaaaggagagaaaggagaccggggacccaagggagaaagggggatggatggagccagtattgtgggaccccctgggccgagagggccacctgggcacatcaaggtcttgtctaattccttgatcaatatcacccatggattcatgaatttctcggacattcctgagctggtggggcctccggggccggacgggttgcctgggctgccaggatttccaggtcctagaggaccaaaaggtgacactggtttacctggctttccaggactaaaaggagaacagggcgagaagggagagccgggtgccatcctgacagaggacattcctctggaaaggctgatggggaaaaagggtgaacctggaatgcatggagccccaggaccaatggggcccaaaggaccaccaggacataaaggagaatttggccttcccgggcgacctggtcgcccaggactgaatggcctcaagggtaccaaaggagatccaggggtcattatgcagggcccacctggcttacctggccctccaggcccccctgggccacctggagctgtgattaacatcaaaggagccattttcccaatacccgtccgaccacactgcaaaatgccagttgatactgctcatcctgggagtccagagctcatcacttttcacggtgttaaaggagagaaaggatcctggggtcttcctggctcaaagggagaaaaaggcgaccagggagcccagggaccaccaggtcctccacttgatctagcttacctgagacactttctgaacaacttgaagggggagaatggagacaaggggttcaaaggtgaaaaaggagaaaaaggagacattaatggcagcttccttatgtctgggcctccaggcctgcccggaaatccaggcccggctggccaaaaaggggagacagtcgttgggccccaaggacccccaggtgctcctggtctgcctgggccacctggctttggaagacctggtgatcctgggccaccggggcccccggggccaccaggacctccagctatcctgggagcagctgtggcccttccaggtccccctggccctccaggacagccagggcttcccggatccagaaacctggtcacagcattcagcaacatggatgacatgctgcagaaagcgcatttggttatagaaggaacattcatctacctgagggacagcactgagtttttcattcgtgttagagatggctggaaaaaattacagctgggagaactgatccccattcctgccgacagccctccaccccctgcgctttccagcaacccacatcagcttctgcctccaccaaaccctatttcaagtgccaattatgagaagcctgctctgcatttggctgctctgaacatgccattttctggggacattcgagctgattttcagtgcttcaagcaggccagagctgcaggactgttgtccacctaccgagcattcttatcttcccatttgcaagatctgtccaccattgtgaggaaagcagagagatacagccttcccatagtgaacctcaagggccaagtactttttaataattgggactcaattttttctggccacggaggtcagttcaatatgcatattccaatatactcctttgatggtcgagacataatgacagatccttcttggccccagaaagtcatttggcatggctccagcccccatggcgtccgccttgtggataactactgtgaagcatggcgaaccgcggacacagcggtcacgggacttgcctccccgctgagcacggggaagattctggaccagaaagcatacagctgtgctaatcggctaattgtcctatgtatcgaaaacagtttcatgacagacgctaggaagtaatggccttctgatgattcttaaagagttttcaattttttcttatgtgaagagttgacactgaaatctaaaatgtttaattgttgtaaatattacagtttttttttttttactacatattctttacaacagcaaccaaagaaaacatacctcaatacactcaaaactgaagacatagaggactcagatcaaagacaaaatctgatccatatattggtgctagattctgcaggaaaccccagcagtgtgaacgcatcccaacataggttaagagcaagttgaaaacaaaggccatggcattctgccactgcatccttcagacagttatatcctccttttaaaccattgttgttgagtgtaagatgtccttcatgttttcttataaagtcagtgtttagaaatgttaccctttctaagttatatacagatcaaatgcttttttctttcacgtacatccatcatttgcaactgctgttcgtacacagaaacaggactgctcaaatgatcctatttgtattttctgatgctatcagactctaatgtttttttccctaaaatattattgccatcatgctttaggaattttatatttttacacaatcatattttagtatggtgtctgtttatgtaactctgacttgctggaaaagttgaaactccaaataatctgaaactagaaaagaaatagcacataattactaccttccccttggcggctctcctccccaacccccaccccacaattttatgacttccatttggcaattgttgaattataactgcgactgaaacaaacaggttcatagagatgaattttctgagaaacatatatctacatgttgtataattggattttttttccatgtaagtgaacataaaaacatcttttccgggtgctttcttcatttgactttttcccgctagttcctttattctccatcactgatgtggaagcagacctggggtgggtttgctaatcctgccacttgtgctgcccccaggcgatgatcagagaactgaaacgttttcccatcatgctcatctgccctggctgttgtcttccacctagtggggccagtgtaggttgtgtagagcctcagagtgggaaacaggatgagctgtgattctgccaccgtctcagggcatgactttgggcaagtcggcctctgtctctcaaggagattgggataagacaagcatagtattggctaccagtcattaaatatcagacttctgatatatcccattt

SEQ ID NO: 455369 - DNA, 5265 bp, Homo sapiens
ggagtcgggtttcagagcgcgggtgactcggggcgcgggccgggagccgggattctgcccgccgccgccgctgccgagcgccgcctttgttccctgcaggaagggcgagcgcggcggccagcgctcagcgacccttcgtcctccgctaagctccaacgctctgctcgactagccgcgcgccttccggggctccgcagacccgcgagatggcaccaaggaggaacaacgggcagtgctggtgtctgctgatgctgctctcggtctccacgcccctccctgctgtcacccagacccgcggtgcgacagagactgcttcccagggtcacctggacctcacgcagctcatcggtgtcccgctgccctcgtccgtatcctttgtcacaggctatggtggcttcccggcctacagtttcgggcctggtgccaatgttggccgcccagccaggactctcatcccatccaccttcttcagggacttcgccatcaggctcgtggtgaagcccagcagcacccgtggtggcgtgctcttcgccatcactgacgccttccagaaggtcatctacctgggcctgcggctctcaggtgtggaggacggccaccagcggatcatcctctactacacggagccaggctcccatgtgtcccaagaggctgctgccttctcggtgcctgtgatgacccacaggtggaaccgcttcgccatgattgtccagggtgaggaagtgaccctcctcgtgaactgtgaggagcacagccgcatccccttccagcggtcctcccaggctttggcttttgagtccagcgctggaatcttcatgggcaatgcaggagctacagggctcgagagattcactggctccctccagcagctcaccgtgcaccccgaccccaggactcccgaggagctgtgtgaccctgaagagtcctcggcatctggagagaccagtgggctgcaggaggcagacggagtagctgagatcttagaagccgtcacctacactcaagcctcgcccaaagaagcaaaagttgaacccataaacacacctccaactccatcctccccctttgaagacatggaactttctggtgaacctgtacccgaggggaccctggaaaccaccaacatgagcatcatccagcacagcagccccaaacaagggtctggtgagatcctgaatgacacactggagggggttcattctgtggatggtgaccccattactgacagcggctcaggggctggggccttccttgacattgctgaagaaaagaatttagcagcaacagcagcggggctggccgaggtgcccatcagcactgctggagaagcagaggccagcagtgtgcccaccgggggaccaaccctctctatgtccacggagaacccagaggaaggggtcactccaggtccagataatgaagagcgtttacgcagcaacagcagcaggggaggccgaggcactcgccagcatgcctggggaagtggaggccagtggtgtggcccccggggagctggacctctccatgtccgcccagagcctcggggaagaggccactgtgggtccaagcagtgaagacagtttaacaacagctgcagctgcaaccgaagtgtccctcagtacttttgaggatgaggaagccagtggggtccccacagatggcctggctcccctcacagccaccatggcccctgagcgggcagtcacttctggtcctggtgatgaagaagacttggcagcagccacaacagaggagcccctcatcacagctgggggtgaagagtccggcagccctccccctgatgggccaccgctgcccctgcccacagtggctcctgaaagatggatcactccagctcaaagagaacatgtgggaatgaaaggacaggctgggcccaaaggagaaaagggtgatgctggggaggagcttcctggccctcctgaaccttctgggcctgttggacccacggcaggagcagaagcagagggctctggcctaggctggggctcggacgtcggctctggctctggtgacctggtgggcagtgagcagctgctgagaggtcctccaggacccccagggccacctggcttacctgggattccaggaaaaccaggaactgatgttttcatgggaccccctggatctcctggagaggatggacctgctggtgaacctgggcccccgggccctgagggacagcctggagttgatggagccaccggccttcccgggatgaaaggggagaagggagcaagagggcctaatggctcagttggtgaaaagggtgaccctggcaacagaggcttacctggacccccggggaaaaagggacaagctggccctcctggggtcatgggacccccagggcctcctggaccccctgggcccccaggccctggatgcacaatgggacttggattcgaggataccgaaggctctggaagcacccagctattgaatgaacccaaactctccagaccaacggctgcaattggtctcaaaggagagaaaggagaccggggacccaagggagaaagggggatggatggagccagtattgtgggaccccctgggccgagagggccacctgggcacatcaaggtcttgtctaattccttgatcaatatcacccatggattcatgaatttctcggacattcctgagctggtggggcctccggggccggacgggttgcctgggctgccaggatttccaggtcctagaggaccaaaaggtgacactggtttacctggctttccaggactaaaaggagaacagggcgagaagggagagccgggtgccatcctgacagaggacattcctctggaaaggctgatggggaaaaagggtgaacctggaatgcatggagccccaggaccaatggggcccaaaggaccaccaggacataaaggagaatttggccttcccgggcgacctggtcgcccaggactgaatggcctcaagggtaccaaaggagatccaggggtcattatgcagggcccacctggcttacctggccctccaggcccccctgggccacctggagctgtgattaacatcaaaggagccattttcccaatacccgtccgaccacactgcaaaatgccagttgatactgctcatcctgggagtccagagctcatcacttttcacggtgttaaaggagagaaaggatcctggggtcttcctggctcaaagggagaaaaaggcgaccagggagcccagggaccaccaggtcctccacttgatctagcttacctgagacactttctgaacaacttgaagggggagaatggagacaaggggttcaaaggtgaaaaaggagaaaaaggagacattaatggcagcttccttatgtctgggcctccaggcctgcccggaaatccaggcccggctggccaaaaaggggagacagtcgttgggccccaaggacccccaggtgctcctggtctgcctgggccacctggctttggaagacctggtgatcctgggccaccggggcccccggggccaccaggacctccagctatcctgggagcagctgtggcccttccaggtccccctggccctccaggacagccagggcttcccggatccagaaacctggtcacagcattcagcaacatggatgacatgctgcagaaagcgcatttggttatagaaggaacattcatctacctgagggacagcactgagtttttcattcgtgttagagatggctggaaaaaattacagctgggagaactgatccccattcctgccgacagccctccaccccctgcgctttccagcaacccacatcagcttctgcctccaccaaaccctatttcaagtgccaattatgagaagcctgctctgcatttggctgctctgaacatgccattttctggggacattcgagctgattttcagtgcttcaagcaggccagagctgcaggactgttgtccacctaccgagcattcttatcttcccatttgcaagatctgtccaccattgtgaggaaagcagagagatacagccttcccatagtgaacctcaagggccaagtactttttaataattgggactcaattttttctggccacggaggtcagttcaatatgcatattccaatatactcctttgatggtcgagacataatgacagatccttcttggccccagaaagtcatttggcatggctccagcccccatggcgtccgccttgtggataactactgtgaagcatggcgaaccgcggacacagcggtcacgggacttgcctccccgctgagcacggggaagattctggaccagaaagcatacagctgtgctaatcggctaattgtcctatgtatcgaaaacagtttcatgacagacgctaggaagtaatggccttctgatgattcttaaagagttttcaattttttcttatgtgaagagttgacactgaaatctaaaatgtttaattgttgtaaatattacagtttttttttttttactacatattctttacaacagcaaccaaagaaaacatacctcaatacactcaaaactgaagacatagaggactcagatcaaagacaaaatctgatccatatattggtgctagattctgcaggaaaccccagcagtgtgaacgcatcccaacataggttaagagcaagttgaaaacaaaggccatggcattctgccactgcatccttcagacagttatatcctccttttaaaccattgttgttgagtgtaagatgtccttcatgttttcttataaagtcagtgtttagaaatgttaccctttctaagttatatacagatcaaatgcttttttctttcacgtacatccatcatttgcaactgctgttcgtacacagaaacaggactgctcaaatgatcctatttgtattttctgatgctatcagactctaatgtttttttccctaaaatattattgccatcatgctttaggaattttatatttttacacaatcatattttagtatggtgtctgtttatgtaactctgacttgctggaaaagttgaaactccaaataatctgaaactagaaaagaaatagcacataattactaccttccccttggcggctctcctccccaacccccaccccacaattttatgacttccatttggcaattgttgaattataactgcgactgaaacaaacaggttcatagagatgaattttctgagaaacatatatctacatgttgtataattggattttttttccatgtaagtgaacataaaaacatcttttccggg

SEQ ID NO: 455370 - DNA, 5212 bp, Homo sapiens
ggagtcgggtttcagagcgcgggtgactcggggcgcgggccgggagccgggattctgcccgccgccgccgctgccgagcgccgcctttgttccctgcaggaagggcgagcgcggcggccagcgctcagcgacccttcgtcctccgctaagctccaacgctctgctcgactagccgcgcgccttccggggctccgcagacccgcgagatggcaccaaggaggaacaacgggcagtgctggtgtctgctgatgctgctctcggtctccacgcccctccctgctgtcacccagacccgcggtgcgacagagactgcttcccagggtcacctggacctcacgcagctcatcggtgtcccgctgccctcgtccgtatcctttgtcacaggctatggtggcttcccggcctacagtttcgggcctggtgccaatgttggccgcccagccaggactctcatcccatccaccttcttcagggacttcgccatcaggctcgtggtgaagcccagcagcacccgtggtggcgtgctcttcgccatcactgacgccttccagaaggtcatctacctgggcctgcggctctcaggtgtggaggacggccaccagcggatcatcctctactacacggagccaggctcccatgtgtcccaagaggctgctgccttctcggtgcctgtgatgacccacaggtggaaccgcttcgccatgattgtccagggtgaggaagtgaccctcctcgtgaactgtgaggagcacagccgcatccccttccagcggtcctcccaggctttggcttttgagtccagcgctggaatcttcatgggcaatgcaggagctacagggctcgagagattcactggctccctccagcagctcaccgtgcaccccgaccccaggactcccgaggagctgtgtgaccctgaagagtcctcggcatctggagagaccagtgggctgcaggaggcagacggagtagctgagatcttagaagccgtcacctacactcaagcctcgcccaaagaagcaaaagttgaacccataaacacacctccaactccatcctccccctttgaagacatggaactttctggtgaacctgtacccgaggggaccctggaaaccaccaacatgagcatcatccagcacagcagccccaaacaagggtctggtgagatcctgaatgacacactggagggggttcattctgtggatggtgaccccattactgacagcggctcaggggctggggccttccttgacattgctgaagaaaagaatttagcagcaacagcagcggggctggccgaggtgcccatcagcactgctggagaagcagaggccagcagtgtgcccaccgggggaccaaccctctctatgtccacggagaacccagaggaaggggtcactccaggtccagataatgaagagcgtttacgcagcaacagcagcaggggaggccgaggcactcgccagcatgcctggggaagtggaggccagtggtgtggcccccggggagctggacctctccatgtccgcccagagcctcggggaagaggccactgtgggtccaagcagtgaagacagtttaacaacagctgcagctgcaaccgaagtgtccctcagtacttttgaggatgaggaagccagtggggtccccacagatggcctggctcccctcacagccaccatggcccctgagcgggcagtcacttctggtcctggtgatgaagaagacttggcagcagccacaacagaggagcccctcatcacagctgggggtgaagagtccggcagccctccccctgatgggccaccgctgcccctgcccacagtggctcctgaaagatggatcactccagctcaaagagaacatgtgggaatgaaaggacaggctgggcccaaaggagaaaagggtgatgctggggaggagcttcctggccctcctgaaccttctgggcctgttggacccacggcaggagcagaagcagagggctctggcctaggctggggctcggacgtcggctctggctctggtgacctggtgggcagtgagcagctgctgagaggtcctccaggacccccagggccacctggcttacctgggattccaggaaaaccaggaactgatgttttcatgggaccccctggatctcctggagaggatggacctgctggtgaacctgggcccccgggccctgagggacagcctggagttgatggagccaccggccttcccgggatgaaaggggagaagggagcaagagggcctaatggctcagttggtgaaaagggtgaccctggcaacagaggcttacctggacccccggggaaaaagggacaagctggccctcctggggtcatgggacccccagggcctcctggaccccctgggcccccaggccctggatgcacaatgggacttggattcgaggataccgaaggctctggaagcacccagctattgaatgaacccaaactctccagaccaacggctgcaattggtctcaaaggagagaaaggagaccggggacccaagggagaaagggggatggatggagccagtattgtgggaccccctgggccgagagggccacctgggcacatcaaggtcttgtctaattccttgatcaatatcacccatggattcatgaatttctcggacattcctgagctggtggggcctccggggccggacgggttgcctgggctgccaggatttccaggtcctagaggaccaaaaggtgacactggtttacctggctttccaggactaaaaggagaacagggcgagaagggagagccgggtgccatcctgacagaggacattcctctggaaaggctgatggggaaaaagggtgaacctggaatgcatggagccccaggaccaatggggcccaaaggaccaccaggacataaaggagaatttggccttcccgggcgacctggtcgcccaggactgaatggcctcaagggtaccaaaggagatccaggggtcattatgcagggcccacctggcttacctggccctccaggcccccctgggccacctggagctgtgattaacatcaaaggagccattttcccaatacccgtccgaccacactgcaaaatgccagttgatactgctcatcctgggagtccagagctcatcacttttcacggtgttaaaggagagaaaggatcctggggtcttcctggctcaaagggagaaaaaggcgaccagggagcccagggaccaccaggtcctccacttgatctagcttacctgagacactttctgaacaacttgaagggggagaatggagacaaggggttcaaaggtgaaaaaggagaaaaaggagacattaatggcagcttccttatgtctgggcctccaggcctgcccggaaatccaggcccggctggccaaaaaggggagacagtcgttgggccccaaggacccccaggtgctcctggtctgcctgggccacctggctttggaagacctggtgatcctgggccaccggggcccccggggccaccaggacctccagctatcctgggagcagctgtggcccttccaggtccccctggccctccaggacagccagggcttcccggatccagaaacctggtcacagcattcagcaacatggatgacatgctgcagaaagcgcatttggttatagaaggaacattcatctacctgagggacagcactgagtttttcattcgtgttagagatggctggaaaaaattacagctgggagaactgatccccattcctgccgacagccctccaccccctgcgctttccagcaacccacatcagcttctgcctccaccaaaccctatttcaagtgccaattatgagaagcctgctctgcatttggctgctctgaacatgccattttctggggacattcgagctgattttcagtgcttcaagcaggccagagctgcaggactgttgtccacctaccgagcattcttatcttcccatttgcaagatctgtccaccattgtgaggaaagcagagagatacagccttcccatagtgaacctcaagggccaagtactttttaataattgggactcaattttttctggccacggaggtcagttcaatatgcatattccaatatactcctttgatggtcgagacataatgacagatccttcttggccccagaaagtcatttggcatggctccagcccccatggcgtccgccttgtggataactactgtgaagcatggcgaaccgcggacacagcggtcacgggacttgcctccccgctgagcacggggaagattctggaccagaaagcatacagctgtgctaatcggctaattgtcctatgtatcgaaaacagtttcatgacagacgctaggaagtaatggccttctgatgattcttaaagagttttcaattttttcttatgtgaagagttgacactgaaatctaaaatgtttaattgttgtaaatattacagtttttttttttttactacatattctttacaacagcaaccaaagaaaacatacctcaatacactcaaaactgaagacatagaggactcagatcaaagacaaaatctgatccatatattggtgctagattctgcaggaaaccccagcagtgtgaacgcatcccaacataggttaagagcaagttgaaaacaaaggccatggcattctgccactgcatccttcatgttttcttataaagtcagtgtttagaaatgttaccctttctaagttatatacagatcaaatgcttttttctttcacgtacatccatcatttgcaactgctgttcgtacacagaaacaggactgctcaaatgatcctatttgtattttctgatgctatcagactctaatgtttttttccctaaaatattattgccatcatgctttaggaattttatatttttacacaatcatattttagtatggtgtctgtttatgtaactctgacttgctggaaaagttgaaactccaaataatctgaaactagaaaagaaatagcacataattactaccttccccttggcggctctcctccccaacccccaccccacaattttatgacttccatttggcaattgttgaattataactgcgactgaaacaaacaggttcatagagatgaattttctgagaaacatatatctacatgttgtataattggattttttttccatgtaagtgaacataaaaacatcttttccggg

SEQ ID NO: 455371 - DNA, 4308 bp, Homo sapiens
ggagtcgggtttcagagcgcgggtgactcggggcgcgggccgggagccgggattctgcccgccgccgccgctgccgagcgccgcctttgttccctgcaggaagggcgagcgcggcggccagcgctcagcgacccttcgtcctccgctaagctccaacgctctgctcgactagccgcgcgccttccggggctccgcagacccgcgagatggcaccaaggaggaacaacgggcagtgctggtgtctgctgatgctgctctcggtctccacgcccctccctgctgtcacccagacccgcggtgcgacagagactgcttcccagggtcacctggacctcacgcagctcatcggtgtcccgctgccctcgtccgtatcctttgtcacaggctatggtggcttcccggcctacagtttcgggcctggtgccaatgttggccgcccagccaggactctcatcccatccaccttcttcagggacttcgccatcaggctcgtggtgaagcccagcagcacccgtggtggcgtgctcttcgccatcactgacgccttccagaaggtcatctacctgggcctgcggctctcaggtgtggaggacggccaccagcggatcatcctctactacacggagccaggctcccatgtgtcccaagaggctgctgccttctcggtgcctgtgatgacccacaggtggaaccgcttcgccatgattgtccagggtgaggaagtgaccctcctcgtgaactgtgaggagcacagccgcatccccttccagcggtcctcccaggctttggcttttgagtccagcgctggaatcttcatgggcaatgcaggagctacagggctcgagagattcactggctccctccagcagctcaccgtgcaccccgaccccaggactcccgaggagctgtgtgaccctgaagagtcctcggcatctggagagaccagtgggctgcaggaggcagacggagtagctgagatcttagaagccgtcacctacactcaagcctcgcccaaagaagcaaaagttgaacccataaacacacctccaactccatcctccccctttgaagacatggaactttctggtgaacctgtacccgaggggaccctggaaaccaccaacatgagcatcatccagcacagcagccccaaacaagggtctggtgagatcctgaatgacacactggagggggttcattctgtggatggtgaccccattactgacagcggctcaggggctggggccttccttgacattgctgaagaaaagaatttagcagcaacagcagcggggctggccgaggtgcccatcagcactgctggagaagcagaggccagcagtgtgcccaccgggggaccaaccctctctatgtccacggagaacccagaggaaggggtcactccaggtccagataatgaagagcgtttacgcagcaacagcagcaggggaggccgaggcactcgccagcatgcctggggaagtggaggccagtggtgtggcccccggggagctggacctctccatgtccgcccagagcctcggggaagaggccactgtgggtccaagcagtgaagacagtttaacaacagctgcagctgcaaccgaagtgtccctcagtacttttgaggatgaggaagccagtggggtccccacagatggcctggctcccctcacagccaccatggcccctgagcgggcagtcacttctggtcctggtgatgaagaagacttggcagcagccacaacagaggagcccctcatcacagctgggggtgaagagtccggcagccctccccctgatgggccaccgctgcccctgcccacagtggctcctgaaagatggatcactccagctcaaagagaacatgtgggaatgaaaggacaggctgggcccaaaggagaaaagggtgatgctggggaggagcttcctggccctcctgaaccttctgggcctgttggacccacggcaggagcagaagcagagggctctggcctaggctggggctcggacgtcggctctggctctggtgacctggtgggcagtgagcagctgctgagaggtcctccaggacccccagggccacctggcttacctgggattccaggaaaaccaggaactgatgttttcatgggaccccctggatctcctggagaggatggacctgctggtgaacctgggcccccgggccctgagggacagcctggagttgatggagccaccggccttcccgggatgaaaggggagaagggagcaagagggcctaatggctcagttggtgaaaagggtgaccctggcaacagaggcttacctggacccccggggaaaaagggacaagctggccctcctggggtcatgggacccccagggcctcctggaccccctgggcccccaggccctggatgcacaatgggacttggattcgaggataccgaaggctctggaagcacccagctattgaatgaacccaaactctccagaccaacggctgcaattggtctcaaaggagagaaaggagaccggggacccaagggagaaagggggatggatggagccagtattgtgggaccccctgggccgagagggccacctgggcacatcaaggtcttgtctaattccttgatcaatatcacccatggattcatgaatttctcggacattcctgagctggtggggcctccggggccggacgggttgcctgggctgccaggatttccaggtcctagaggaccaaaaggtgacactggtttacctggctttccaggactaaaaggagaacagggcgagaagggagagccgggtgccatcctgacagaggacattcctctggaaaggctgatggggaaaaagggtgaacctggaatgcatggagccccaggaccaatggggcccaaaggaccaccaggacataaaggagaatttggccttcccgggcgacctggtcgcccaggactgaatggcctcaagggtaccaaaggagatccaggggtcattatgcagggcccacctggcttacctggccctccaggcccccctgggccacctggagctgtgattaacatcaaaggagccattttcccaatacccgtccgaccacactgcaaaatgccagttgatactgctcatcctgggagtccagagctcatcacttttcacggtgttaaaggagagaaaggatcctggggtcttcctggctcaaagggagaaaaaggcgaccagggagcccagggaccaccaggtcctccacttgatctagcttacctgagacactttctgaacaacttgaagggggagaatggagacaaggggttcaaaggtgaaaaaggagaaaaaggagacattaatggcagcttccttatgtctgggcctccaggcctgcccggaaatccaggcccggctggccaaaaaggggagacagtcgttgggccccaaggacccccaggtgctcctggtctgcctgggccacctggctttggaagacctggtgatcctgggccaccggggcccccggggccaccaggacctccagctatcctgggagcagctgtggcccttccaggtccccctggccctccaggacagccagggcttcccggatccagaaacctggtcacagcattcagcaacatggatgacatgctgcagaaagcgcatttggttatagaaggaacattcatctacctgagggacagcactgagtttttcattcgtgttagagatggctggaaaaaattacagctgggagaactgatccccattcctgccgacagccctccaccccctgcgctttccagcaacccacatcagcttctgcctccaccaaaccctatttcaagtgccaattatgagaagcctgctctgcatttggctgctctgaacatgccattttctggggacattcgagctgattttcagtgcttcaagcaggccagagctgcaggactgttgtccacctaccgagcattcttatcttcccatttgcaagatctgtccaccattgtgaggaaagcagagagatacagccttcccatagtgaacctcaaggtaaaaataaatatggttcccattgccttctgcatgcattggtcgctacagggcctggaggcagttttcattcctgacatcaacagaagactgttgacttaagcctgctctctcccttactggctatgtcactttgggtgggttctttgccttccctgaacctcagttttctttatgcttgtgtgacccttgaagcatgcaggaggagagatagtgataacttctttcattgatacagggtattaagctcatggtgctagctct

SEQ ID NO: 455372 - DNA, 138 bp, Homo sapiens
aaaaaaaaaaaagagtaaaaatctaactcatttgtaggctgatggtataatgattctaatgtggtattttgtctctatagggccaagtactttttaataattgggactcaattttttctggccacggaggtcagttca

SEQ ID NO: 455373 - DNA, 323 bp, Homo sapiens
gtctgcctgggccacctggctttggaagacctggtgatcctgggccaccggggcccccggggccaccaggacctccagctatcctgggagcaggttagtgccgtaaacagtgcccttgttcatgctgtccctaccattgtgttcaaggtcacagcatctgggtggcttgtcacagctgcactgcctaacagagggctttcctggataccgccttctttcttttttttttaattgagatacaatttgcacatcataaaattcacccacctaaagtgtctaatccagtagtttttaatatattcatgaagttatgcagtcatcac

SEQ ID NO: 455374 - DNA, 5652 bp, Homo sapiens
cacccaagactgtgctccttcattcatccagcgtttattggcatctcctactacctgagctgttttaggcagggaacaaagcacagataagccctcctggagcttacattctgatgaagggggcaggcaaggaagggcgagcgcggcggccagcgctcagcgacccttcgtcctccgctaagctccaacgctctgctcgactagccgcgcgccttccggggctccgcagacccgcgagatggcaccaaggaggaacaacgggcagtgctggtgtctgctgatgctgctctcggtctccacgcccctccctgctgtcacccagacccgcggtgcgacagagactgcttcccagggtcacctggacctcacgcagctcatcggtgtcccgctgccctcgtccgtatcctttgtcacaggctatggtggcttcccggcctacagtttcgggcctggtgccaatgttggccgcccagccaggactctcatcccatccaccttcttcagggacttcgccatcaggctcgtggtgaagcccagcagcacccgtggtggcgtgctcttcgccatcactgacgccttccagaaggtcatctacctgggcctgcggctctcaggtgtggaggacggccaccagcggatcatcctctactacacggagccaggctcccatgtgtcccaagaggctgctgccttctcggtgcctgtgatgacccacaggtggaaccgcttcgccatgattgtccagggtgaggaagtgaccctcctcgtgaactgtgaggagcacagccgcatccccttccagcggtcctcccaggctttggcttttgagtccagcgctggaatcttcatgggcaatgcaggagctacagggctcgagagattcactggctccctccagcagctcaccgtgcaccccgaccccaggactcccgaggagctgtgtgaccctgaagagtcctcggcatctggagagaccagtgggctgcaggaggcagacggagtagctgagatcttagaagccgtcacctacactcaagcctcgcccaaagaagcaaaagttgaacccataaacacacctccaactccatcctccccctttgaagacatggaactttctggtgaacctgtacccgaggggaccctggaaaccaccaacatgagcatcatccagcacagcagccccaaacaagggtctggtgagatcctgaatgacacactggagggggttcattctgtggatggtgaccccattactgacagcggctcaggggctggggccttccttgacattgctgaagaaaagaatttagcagcaacagcagcggggctggccgaggtgcccatcagcactgctggagaagcagaggccagcagtgtgcccaccgggggaccaaccctctctatgtccacggagaacccagaggaaggggtcactccaggtccagataatgaagagcgtttacgcagcaacagcagcaggggaggccgaggcactcgccagcatgcctggggaagtggaggccagtggtgtggcccccggggagctggacctctccatgtccgcccagagcctcggggaagaggccactgtgggtccaagcagtgaagacagtttaacaacagctgcagctgcaaccgaagtgtccctcagtacttttgaggatgaggaagccagtggggtccccacagatggcctggctcccctcacagccaccatggcccctgagcgggcagtcacttctggtcctggtgatgaagaagacttggcagcagccacaacagaggagcccctcatcacagctgggggtgaagagtccggcagccctccccctgatgggccaccgctgcccctgcccacagtggctcctgaaagatggatcactccagctcaaagagaacatgtgggaatgaaaggacaggctgggcccaaaggagaaaagggtgatgctggggaggagcttcctggccctcctgaaccttctgggcctgttggacccacggcaggagcagaagcagagggctctggcctaggctggggctcggacgtcggctctggctctggtgacctggtgggcagtgagcagctgctgagaggtcctccaggacccccagggccacctggcttacctgggattccaggaaaaccaggaactgatgttttcatgggaccccctggatctcctggagaggatggacctgctggtgaacctgggcccccgggccctgagggacagcctggagttgatggagccaccggccttcccgggatgaaaggggagaagggagcaagagggcctaatggctcagttggtgaaaagggtgaccctggcaacagaggcttacctggacccccggggaaaaagggacaagctggccctcctggggtcatgggacccccagggcctcctggaccccctgggcccccaggccctggatgcacaatgggacttggattcgaggataccgaaggctctggaagcacccagctattgaatgaacccaaactctccagaccaacggctgcaattggtctcaaaggagagaaaggagaccggggacccaagggagaaagggggatggatggagccagtattgtgggaccccctgggccgagagggccacctgggcacatcaaggtcttgtctaattccttgatcaatatcacccatggattcatgaatttctcggacattcctgagctggtggggcctccggggccggacgggttgcctgggctgccaggatttccaggtcctagaggaccaaaaggtgacactggtttacctggctttccaggactaaaaggagaacagggcgagaagggagagccgggtgccatcctgacagaggacattcctctggaaaggctgatggggaaaaagggtgaacctggaatgcatggagccccaggaccaatggggcccaaaggaccaccaggacataaaggagaatttggccttcccgggcgacctggtcgcccaggactgaatggcctcaagggtaccaaaggagatccaggggtcattatgcagggcccacctggcttacctggccctccaggcccccctgggccacctggagctgtgattaacatcaaaggagccattttcccaatacccgtccgaccacactgcaaaatgccagttgatactgctcatcctgggagtccagagctcatcacttttcacggtgttaaaggagagaaaggatcctggggtcttcctggctcaaagggagaaaaaggcgaccagggagcccagggaccaccaggtcctccacttgatctagcttacctgagacactttctgaacaacttgaagggggagaatggagacaaggggttcaaaggtgaaaaaggagaaaaaggagacattaatggcagcttccttatgtctgggcctccaggcctgcccggaaatccaggcccggctggccaaaaaggggagacagtcgttgggccccaaggacccccaggtgctcctggtctgcctgggccacctggctttggaagacctggtgatcctgggccaccggggcccccggggccaccaggacctccagctatcctgggagcagctgtggcccttccaggtccccctggccctccaggacagccagggcttcccggatccagaaacctggtcacagcattcagcaacatggatgacatgctgcagaaagcgcatttggttatagaaggaacattcatctacctgagggacagcactgagtttttcattcgtgttagagatggctggaaaaaattacagctgggagaactgatccccattcctgccgacagccctccaccccctgcgctttccagcaacccacatcagcttctgcctccaccaaaccctatttcaagtgccaattatgagaagcctgctctgcatttggctgctctgaacatgccattttctggggacattcgagctgattttcagtgcttcaagcaggccagagctgcaggactgttgtccacctaccgagcattcttatcttcccatttgcaagatctgtccaccattgtgaggaaagcagagagatacagccttcccatagtgaacctcaagggccaagtactttttaataattgggactcaattttttctggccacggaggtcagttcaatatgcatattccaatatactcctttgatggtcgagacataatgacagatccttcttggccccagaaagtcatttggcatggctccagcccccatggcgtccgccttgtggataactactgtgaagcatggcgaaccgcggacacagcggtcacgggacttgcctccccgctgagcacggggaagattctggaccagaaagcatacagctgtgctaatcggctaattgtcctatgtatcgaaaacagtttcatgacagacgctaggaagtaatggccttctgatgattcttaaagagttttcaattttttcttatgtgaagagttgacactgaaatctaaaatgtttaattgttgtaaatattacagtttttttttttttactacatattctttacaacagcaaccaaagaaaacatacctcaatacactcaaaactgaagacatagaggactcagatcaaagacaaaatctgatccatatattggtgctagattctgcaggaaaccccagcagtgtgaacgcatcccaacataggttaagagcaagttgaaaacaaaggccatggcattctgccactgcatccttcagacagttatatcctccttttaaaccattgttgttgagtgtaagatgtccttcatgttttcttataaagtcagtgtttagaaatgttaccctttctaagttatatacagatcaaatgcttttttctttcacgtacatccatcatttgcaactgctgttcgtacacagaaacaggactgctcaaatgatcctatttgtattttctgatgctatcagactctaatgtttttttccctaaaatattattgccatcatgctttaggaattttatatttttacacaatcatattttagtatggtgtctgtttatgtaactctgacttgctggaaaagttgaaactccaaataatctgaaactagaaaagaaatagcacataattactaccttccccttggcggctctcctccccaacccccaccccacaattttatgacttccatttggcaattgttgaattataactgcgactgaaacaaacaggttcatagagatgaattttctgagaaacatatatctacatgttgtataattggattttttttccatgtaagtgaacataaaaacatcttttccgggtgctttcttcatttgactttttcccgctagttcctttattctccatcactgatgtggaagcagacctggggtgggtttgctaatcctgccacttgtgctgcccccaggcgatgatcagagaactgaaacgttttcccatcatgctcatctgccctggctgttgtcttccacctagtggggccagtgtaggttgtgtagagcctcagagtgggaaacaggatgagctgtgattctgccaccgtctcagggcatgactttgggcaagtcggcctctgtctctcaaggagattgggataagacaagcatagtattggctaccagtcattaaatatcagacttctgatatatcccattt

SEQ ID NO: 455375 - DNA, 1591 bp, Homo sapiens
atcgagctcggtacctaatttttatttctttttgcgtgttagagatggctggaaaaaattacagctgggagaactgatccccattcctgccgacagccctccaccccctgcgctttccagcaacccacatcagcttctgcctccaccaaaccctatttcaagtgccaattatgagaagcctgctctgcatttggctgctctgaacatgccattttctggggacattcgagctgattttcagtgcttcaagcaggccagagctgcaggactgttgtccacctaccgagcattcttatcttcccatttgcaagatctgtccaccattgtgaggaaagcagagagatacagccttcccatagtgaacctcaagggccaagtactttttaataattgggactcaattttttctggccacggaggtcagttcaatatgcatattccaatatactcctttgatggtcgagacataatgacagatccttcttggccccagaaagtcatttggcatggctccagcccccatggcgtccgccttgtggataactactgtgaagcatggcgaaccgcggacacagcggtcacgggacttgcctccccgctgagcacggggaagattctggaccagaaagcatacagctgtgctaatcggctaattgtcctatgtatcgaaaacagtttcatgacagacgctaggaagtaatggccttctgatgattcttaaagagttttcaattttttcttatgtgaagagttgacactgaaatctaaaatgtttaattgttgtaaatattacagtttttttttttttactacatattctttacaacagcaaccaaagaaaacatacctcaatacactcaaaactgaagacatagaggactcagatcaaagacaaaatctgatccatatattggtgctagattctgcaggaaaccccagcagtgtgaacgcatcccaacataggttaagagcaagttgaaaacaaaggccatggcattctgccactgcatccttcagacagttatatcctccttttaaaccattgttgttgagtgtaagatgtccttcatgttttcttataaagtcagtgtttagaaatgttaccctttctaagttatatacagatcaaatgcttttttctttcacgtacatccatcatttgcaactgctgttcgtacacagaaacaggactgctcaaatgatcctatttgtattttctgatgctatcagactctaatgtttttttccctaaaatattattgccatcatgctttaggaattttatatttttacacaatcatattttagtatggtgtctgtttatgtaactctgacttgctggaaaagttgaaactccaaataatctgaaactagaaaagaaatagcacataattactaccttccccttggcggctctcctccccaacccccaccccacaattttatgacttccatttggcaattgttgaattataactgcgactgaaacaaacaggttcatagagatgaattttctgagaaacatatatctacatgttgtataattggattttttttccatgtaagtgaacataaaaacatcttttccggg

SEQ ID NO: 455376 - DNA, 1670 bp, Homo sapiens
ttttttcacctaaggaagacatttctaccacttagagctgttcagagagctgaaacaggctgcttgggagaccatagctctccttccccggaaatggtcaggcagagactgtaattccaatgtcagggagggattgaataaaatgacctccaacgtgccttccagcctaagaagtctggaatctttgcaggaatgtgagatggttctgggggctggagtttgcctttgattctgactgctctcttttgtctcacatttttcagctgcatttggctgctctgaacatgccattttctggggacattcgagctgattttcagtgcttcaagcaggccagagctgcaggactgttgtccacctaccgagcattcttatcttcccatttgcaagatctgtccaccattgtgaggaaagcagagagatacagccttcccatagtgaacctcaagggccaagtactttttaataattgggactcaattttttctggccacggaggtcagttcaatatgcatattccaatatactcctttgatggtcgagacataatgacagatccttcttggccccagaaagtcatttggcatggctccagcccccatggcgtccgccttgtggataactactgtgaagcatggcgaaccgcggacacagcggtcacgggacttgcctccccgctgagcacggggaagattctggaccagaaagcatacagctgtgctaatcggctaattgtcctatgtatcgaaaacagtttcatgacagacgctaggaagtaatggccttctgatgattcttaaagagttttcaattttttcttatgtgaagagttgacactgaaatctaaaatgtttaattgttgtaaatattacagtttttttttttttactacatattctttacaacagcaaccaaagaaaacatacctcaatacactcaaaactgaagacatagaggactcagatcaaagacaaaatctgatccatatattggtgctagattctgcaggaaaccccagcagtgtgaacgcatcccaacataggttaagagcaagttgaaaacaaaggccatggcattctgccactgcatccttcagacagttatatcctccttttaaaccattgttgttgagtgtaagatgtccttcatgttttcttataaagtcagtgtttagaaatgttaccctttctaagttatatacagatcaaatgcttttttctttcacgtacatccatcatttgcaactgctgttcgtacacagaaacaggactgctcaaatgatcctatttgtattttctgatgctatcagactctaatgtttttttccctaaaatattattgccatcatgctttaggaattttatatttttacacaatcatattttagtatggtgtctgtttatgtaactctgacttgctggaaaagttgaaactccaaataatctgaaactagaaaagaaatagcacataattactaccttccccttggcggctctcctccccaacccccaccccacaattttatgacttccatttggcaattgttgaattataactgcgactgaaacaaacaggttcatagagatgaattttctgagaaacatatatctacatgttgtataattggattttttttccatgtaagtgaacataaaaacatcttttccggg

SEQ ID NO: 455377 - DNA, 4563 bp, Homo sapiens
ggctgcggggtgagaggccagggccgagaagggcttcaggacgcgggaggcgcacttgcttcaagtcgcgggcgtgggaacggggttgcaaaacggggcctctttgtccgggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaatatgtgactattattgggtattacacttcacttctctttaatatttttcctccaactggagggcagacaattttctgacttgcttttctctaggtggttcattttgaaaggggacagaaatataactaaatgcttccaggagaaaaattccaagagttacaatctggacttggtacctaaatatcattttttaaattcttgatgcctatttggactagaggtaaacatactttcagattggcctgtttttgtcggtaaggcatacagccttcagaagccaacatttttaatcaaaaacttataaaacatgatgatcattgtgaaaattctgagttgaaggttagtttaagataagctaacaataacagtctgtgttttctctaaaataatctgagttttttggaactctttatttaaatatgtgtgtttttcagtattcaaataagatcaggaagccaattttctatgtatgaatatgctttaacctaggatttcagtccactctgactgactttctaaactttaacttgggtttttacagtgactatgcattagtgctgactctttggtataagccataaaatattttccttcctatcaatttatctgaactttggtcttttcactaaattgtacagtattctacttctgtttaaaacggggagatgagaaagggaatactatctaaccaataacttgaacaaaaacactaaactaagcatttaatagaaatgctttttattgaggaggtattatccagagttcatgcttagaacaaatgcatctttgcgtatcctagacttaacaattcatcagtttctgagaccacagaatcaggttttccgtagtagataaagactctctggtgcttcaaattctgttcaagtgttttgactcatcagcttctactctttctattactgcctttgcctggcttgttttgtctctttgcaactgattttgcaaaaaaaaattgtagctttaaaataacagggtctaagtattttaaatgtgcctatttcacagctctcttggtcacaaaaacatgctatttttattggaacttcaaaccaaatccccactgagtgtgtactggttcctgcaggtagcagtctcctattatctcctgtttagcaccaaaagagctaatattattggaaactgaccttttaaaggccactggcagtaggatttaaaaagcagcccactgctcagtttccaggatcagcttcctccttctgtcacttgtgtaagttggcactaccttgtgcctctcagattgctgaagtgctgctggtaagcatgtgcatgctctgcctttcttgtgaaagttttcaatcagcgatatcagcacttacagtaagaagtaaaagtagtgcacagcaaagctaatttgcctttgcctggggtgttcagcttgaaagaataaagctcatttggtttagttaaatgtcttactctactgtgcctatgcttttagctgcgttactaagcaagggaaaaataacagtttctctgagccagagaagacttgatcacagttctccaagcatcgtgatagcaatgcttaaccccaggaagatttcaaggcagggagaagaacatttcaaataagattcttgttaacccatttatgcctagtgttccattattggaatgctaagcttgtgggagtcatttacatcctactgctcaaagtcattgccaaggtctgatttttcacacaaaaaattgcaacccccagcataaatgggttagctactgtcatcagttagcaaattcatccacacaaacacaattagagtttggtttttttttaagcttttcaaaacttactaaactggcacaattttatatgtatgctatttgttgtatttatgcttaagagcaaaaaagttttgatgggattttaaattcaggcaaagcctacaacgctgagacaatcccctaacaacatggtagtaactaaagaaacttttatactaggcttcttagttttaaaaggaagtggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcatttatcctgtcacatgtttctgtttctatagtaatttagaaattgcaaatagttaacttttcatcatgtaaaaagttaacattatcctatttccatagataccatggacggcggtgtggcctgagttgtcagtctttaatcctgagtcatgtggctctcttttcatctttgatgtcagttccaattatttggcatcaaaaaccttcatggtaggtagagttttaggtaaaagtggatctagggttactttctttattaacatttcctaaataactgaattgagagacatactctgctactatgtcctcaggttaatttttgtctgatcttacgatgccctgccttttactagctactttagaaatagaaaatgtgaagagtgactatttacatgtatactcctttggctgctagaactcatctgtagtcctttattatttacactgaattccaatttcatttctgcttccgctaagtaagagcacctcattcctgtgttttctctactattgagctgtagacgaactgtttctctaattataaagcaaactgtttgggatattcagggaaactaccccaatgttatgttgtcatttaatgggaaaggctgggatcatatgtatttctatgttctgtaaagtatttgacttactagttctcaataaaattttattaggactata

SEQ ID NO: 455378 - DNA, 370 bp, Homo sapiens
gcggccgcgactactactactagcctactactactaaattcgcggccgctcgacaaaatgtgaagagtgactatttacatgtatactcctttggctgctagaactcatctgtagtcctttattatttacactgaattccaatttcatttctgcttccgctaagtaagagcacctcattcctgtgttttctctactattgagctgtagacgaactgtttctctaattataaagcaaactgtttgggatattcagggaaactaccccaatgttatgttgtcatttaatgggaaaggctgggatcatatgtatttctatgttctgtaaagtatttgacttactagttctcaataaaattttattaggactata

SEQ ID NO: 455379 - DNA, 4498 bp, Homo sapiens
ggctgcggggtgagaggccagggccgagaagggcttcaggacgcgggaggcgcacttgcttcaagtcgcgggcgtgggaacggggttgcaaaacggggcctctttgtccgggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaatatgtgactattattgggtattacacttcacttctctttaatatttttcctccaactggagggcagacaattttctgacttgcttttctctaggtggttcattttgaaaggggacagaaatataactaaatgcttccaggagaaaaattccaagagttacaatctggacttggtacctaaatatcattttttaaattcttgatgcctatttggactagaggtaaacatactttcagattggcctgtttttgtcggtaaggcatacagccttcagaagccaacatttttaatcaaaaacttataaaacatgatgatcattgtgaaaattctgagttgaaggttagtttaagataagctaacaataacagtctgtgttttctctaaaataatctgagttttttggaactctttatttaaatatgtgtgtttttcagtattcaaataagatcaggaagccaattttctatgtatgaatatgctttaacctaggatttcagtccactctgactgactttctaaactttaacttgggtttttacagtgactatgcattagtgctgactctttggtataagccataaaatattttccttcctatcaatttatctgaactttggtcttttcactaaattgtacagtattctacttctgtttaaaacggggagatgagaaagggaatactatctaaccaataacttgaacaaaaacactaaactaagcatttaatagaaatgctttttattgaggaggtattatccagagttcatgcttagaacaaatgcatctttgcgtatcctagacttaacaattcatcagtttctgagaccacagaatcaggttttccgtagtagataaagactctctggtgcttcaaattctgttcaagtgttttgactcatcagcttctactctttctattactgcctttgcctggcttgttttgtctctttgcaactgattttgcaaaaaaaaattgtagctttaaaataacagggtctaagtattttaaatgtgcctatttcacagctctcttggtcacaaaaacatgctatttttattggaacttcaaaccaaatccccactgagtgtgtactggttcctgcaggtagcagtctcctattatctcctgtttagcaccaaaagagctaatattattggaaactgaccttttaaaggccactggcagtaggatttaaaaagcagcccactgctcagtttccaggatcagcttcctccttctgtcacttgtgtaagttggcactaccttgtgcctctcagattgctgaagtgctgctggtaagcatgtgcatgctctgcctttcttgtgaaagttttcaatcagcgatatcagcacttacagtaagaagtaaaagtagtgcacagcaaagctaatttgcctttgcctggggtgttcagcttgaaagaataaagctcatttggtttagttaaatgtcttactctactgtgcctatgcttttagctgcgttactaagcaagggaaaaataacagtttctctgagccagagaagacttgatcacagttctccaagcatcgtgatagcaatgcttaaccccaggaagatttcaaggcagggagaagaacatttcaaataagattcttgttaacccatttatgcctagtgttccattattggaatgctaagcttgtgggagtcatttacatcctactgctcaaagtcattgccaaggtctgatttttcacacaaaaaattgcaacccccagcataaatgggttagctactgtcatcagttagcaaattcatccacacaaacacaattagagtttggtttttttttaagcttttcaaaacttactaaactggcacaattttatatgtatgctatttgttgtatttatgcttaagagcaaaaaagttttgatgggattttaaattcaggcaaagcctacaacgctgagacaatcccctaacaacatggtagtaactaaagaaacttttatactaggcttcttagttttaaaaggaagtggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcaatgtaaaaagttaacattatcctatttccatagataccatggacggcggtgtggcctgagttgtcagtctttaatcctgagtcatgtggctctcttttcatctttgatgtcagttccaattatttggcatcaaaaaccttcatggtaggtagagttttaggtaaaagtggatctagggttactttctttattaacatttcctaaataactgaattgagagacatactctgctactatgtcctcaggttaatttttgtctgatcttacgatgccctgccttttactagctactttagaaatagaaaatgtgaagagtgactatttacatgtatactcctttggctgctagaactcatctgtagtcctttattatttacactgaattccaatttcatttctgcttccgctaagtaagagcacctcattcctgtgttttctctactattgagctgtagacgaactgtttctctaattataaagcaaactgtttgggatattcagggaaactaccccaatgttatgttgtcatttaatgggaaaggctgggatcatatgtatttctatgttctgtaaagtatttgacttactagttctcaataaaattttattaggactata

SEQ ID NO: 455380 - DNA, 4661 bp, Homo sapiens
aggagtagagtttgggatggcagcctcagaaggacaaacttaggccaaggagggagggagttggggtggagactgagcttctccagttggaggtctggagctaggactcttcattgaaaccggagagaaggaaaaggagagagtgaggctgactttttaactgaactccaaaattctctgagcaatagaatgggcctaatatgtaccaggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaatatgtgactattattgggtattacacttcacttctctttaatatttttcctccaactggagggcagacaattttctgacttgcttttctctaggtggttcattttgaaaggggacagaaatataactaaatgcttccaggagaaaaattccaagagttacaatctggacttggtacctaaatatcattttttaaattcttgatgcctatttggactagaggtaaacatactttcagattggcctgtttttgtcggtaaggcatacagccttcagaagccaacatttttaatcaaaaacttataaaacatgatgatcattgtgaaaattctgagttgaaggttagtttaagataagctaacaataacagtctgtgttttctctaaaataatctgagttttttggaactctttatttaaatatgtgtgtttttcagtattcaaataagatcaggaagccaattttctatgtatgaatatgctttaacctaggatttcagtccactctgactgactttctaaactttaacttgggtttttacagtgactatgcattagtgctgactctttggtataagccataaaatattttccttcctatcaatttatctgaactttggtcttttcactaaattgtacagtattctacttctgtttaaaacggggagatgagaaagggaatactatctaaccaataacttgaacaaaaacactaaactaagcatttaatagaaatgctttttattgaggaggtattatccagagttcatgcttagaacaaatgcatctttgcgtatcctagacttaacaattcatcagtttctgagaccacagaatcaggttttccgtagtagataaagactctctggtgcttcaaattctgttcaagtgttttgactcatcagcttctactctttctattactgcctttgcctggcttgttttgtctctttgcaactgattttgcaaaaaaaaattgtagctttaaaataacagggtctaagtattttaaatgtgcctatttcacagctctcttggtcacaaaaacatgctatttttattggaacttcaaaccaaatccccactgagtgtgtactggttcctgcaggtagcagtctcctattatctcctgtttagcaccaaaagagctaatattattggaaactgaccttttaaaggccactggcagtaggatttaaaaagcagcccactgctcagtttccaggatcagcttcctccttctgtcacttgtgtaagttggcactaccttgtgcctctcagattgctgaagtgctgctggtaagcatgtgcatgctctgcctttcttgtgaaagttttcaatcagcgatatcagcacttacagtaagaagtaaaagtagtgcacagcaaagctaatttgcctttgcctggggtgttcagcttgaaagaataaagctcatttggtttagttaaatgtcttactctactgtgcctatgcttttagctgcgttactaagcaagggaaaaataacagtttctctgagccagagaagacttgatcacagttctccaagcatcgtgatagcaatgcttaaccccaggaagatttcaaggcagggagaagaacatttcaaataagattcttgttaacccatttatgcctagtgttccattattggaatgctaagcttgtgggagtcatttacatcctactgctcaaagtcattgccaaggtctgatttttcacacaaaaaattgcaacccccagcataaatgggttagctactgtcatcagttagcaaattcatccacacaaacacaattagagtttggtttttttttaagcttttcaaaacttactaaactggcacaattttatatgtatgctatttgttgtatttatgcttaagagcaaaaaagttttgatgggattttaaattcaggcaaagcctacaacgctgagacaatcccctaacaacatggtagtaactaaagaaacttttatactaggcttcttagttttaaaaggaagtggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcatttatcctgtcacatgtttctgtttctatagtaatttagaaattgcaaatagttaacttttcatcatgtaaaaagttaacattatcctatttccatagataccatggacggcggtgtggcctgagttgtcagtctttaatcctgagtcatgtggctctcttttcatctttgatgtcagttccaattatttggcatcaaaaaccttcatggtaggtagagttttaggtaaaagtggatctagggttactttctttattaacatttcctaaataactgaattgagagacatactctgctactatgtcctcaggttaatttttgtctgatcttacgatgccctgccttttactagctactttagaaatagaaaatgtgaagagtgactatttacatgtatactcctttggctgctagaactcatctgtagtcctttattatttacactgaattccaatttcatttctgcttccgctaagtaagagcacctcattcctgtgttttctctactattgagctgtagacgaactgtttctctaattataaagcaaactgtttgggatattcagggaaactaccccaatgttatgttgtcatttaatgggaaaggctgggatcatatgtatttctatgttctgtaaagtatttgacttactagttctcaataaaattttattaggactata

SEQ ID NO: 455381 - DNA, 4770 bp, Homo sapiens
ggctgcggggtgagaggccagggccgagaagggcttcaggacgcgggaggcgcacttgcttcaagtcgcgggcgtgggaacggggttgcaaaacggggcctctttgtccgggtgggttaagggccctggcagctttttcgcgaaggcgccatgtcctagcagttgggccgcagtgggcccgaggtccactcggaccgccgagacggctcgatggccctggagctggaggaagggggatacctgggcgccgccgccgccctcgcaactcggccgaggcccctatctcaacctagtttctgtttttcccctgttctgcaggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaatatgtgactattattgggtattacacttcacttctctttaatatttttcctccaactggagggcagacaattttctgacttgcttttctctaggtggttcattttgaaaggggacagaaatataactaaatgcttccaggagaaaaattccaagagttacaatctggacttggtacctaaatatcattttttaaattcttgatgcctatttggactagaggtaaacatactttcagattggcctgtttttgtcggtaaggcatacagccttcagaagccaacatttttaatcaaaaacttataaaacatgatgatcattgtgaaaattctgagttgaaggttagtttaagataagctaacaataacagtctgtgttttctctaaaataatctgagttttttggaactctttatttaaatatgtgtgtttttcagtattcaaataagatcaggaagccaattttctatgtatgaatatgctttaacctaggatttcagtccactctgactgactttctaaactttaacttgggtttttacagtgactatgcattagtgctgactctttggtataagccataaaatattttccttcctatcaatttatctgaactttggtcttttcactaaattgtacagtattctacttctgtttaaaacggggagatgagaaagggaatactatctaaccaataacttgaacaaaaacactaaactaagcatttaatagaaatgctttttattgaggaggtattatccagagttcatgcttagaacaaatgcatctttgcgtatcctagacttaacaattcatcagtttctgagaccacagaatcaggttttccgtagtagataaagactctctggtgcttcaaattctgttcaagtgttttgactcatcagcttctactctttctattactgcctttgcctggcttgttttgtctctttgcaactgattttgcaaaaaaaaattgtagctttaaaataacagggtctaagtattttaaatgtgcctatttcacagctctcttggtcacaaaaacatgctatttttattggaacttcaaaccaaatccccactgagtgtgtactggttcctgcaggtagcagtctcctattatctcctgtttagcaccaaaagagctaatattattggaaactgaccttttaaaggccactggcagtaggatttaaaaagcagcccactgctcagtttccaggatcagcttcctccttctgtcacttgtgtaagttggcactaccttgtgcctctcagattgctgaagtgctgctggtaagcatgtgcatgctctgcctttcttgtgaaagttttcaatcagcgatatcagcacttacagtaagaagtaaaagtagtgcacagcaaagctaatttgcctttgcctggggtgttcagcttgaaagaataaagctcatttggtttagttaaatgtcttactctactgtgcctatgcttttagctgcgttactaagcaagggaaaaataacagtttctctgagccagagaagacttgatcacagttctccaagcatcgtgatagcaatgcttaaccccaggaagatttcaaggcagggagaagaacatttcaaataagattcttgttaacccatttatgcctagtgttccattattggaatgctaagcttgtgggagtcatttacatcctactgctcaaagtcattgccaaggtctgatttttcacacaaaaaattgcaacccccagcataaatgggttagctactgtcatcagttagcaaattcatccacacaaacacaattagagtttggtttttttttaagcttttcaaaacttactaaactggcacaattttatatgtatgctatttgttgtatttatgcttaagagcaaaaaagttttgatgggattttaaattcaggcaaagcctacaacgctgagacaatcccctaacaacatggtagtaactaaagaaacttttatactaggcttcttagttttaaaaggaagtggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcatttatcctgtcacatgtttctgtttctatagtaatttagaaattgcaaatagttaacttttcatcatgtaaaaagttaacattatcctatttccatagataccatggacggcggtgtggcctgagttgtcagtctttaatcctgagtcatgtggctctcttttcatctttgatgtcagttccaattatttggcatcaaaaaccttcatggtaggtagagttttaggtaaaagtggatctagggttactttctttattaacatttcctaaataactgaattgagagacatactctgctactatgtcctcaggttaatttttgtctgatcttacgatgccctgccttttactagctactttagaaatagaaaatgtgaagagtgactatttacatgtatactcctttggctgctagaactcatctgtagtcctttattatttacactgaattccaatttcatttctgcttccgctaagtaagagcacctcattcctgtgttttctctactattgagctgtagacgaactgtttctctaattataaagcaaactgtttgggatattcagggaaactaccccaatgttatgttgtcatttaatgggaaaggctgggatcatatgtatttctatgttctgtaaagtatttgacttactagttctcaataaaattttattaggactata

SEQ ID NO: 455382 - DNA, 4510 bp, Homo sapiens
ggctgcggggtgagaggccagggccgagaagggcttcaggacgcgggaggcgcacttgcttcaagtcgcgggcgtgggaacggggttgcaaaacggggcctctttgtccgggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaatatgtgactattattgggtattacacttcacttctctttaatatttttcctccaactggagggcagacaattttctgacttgcttttctctaggtggttcattttgaaaggggacagaaatataactaaatgcttccaggagaaaaattccaagagttacaatctggacttggtacctaaatatcattttttaaattcttgatgcctatttggactagaggtaaacatactttcagattggcctgtttttgtcggtaaggcatacagccttcagaagccaacatttttaatcaaaaacttataaaacatgatgatcattgtgaaaattctgagttgaaggttagtttaagataagctaacaataacagtctgtgttttctctaaaataatctgagttttttggaactctttatttaaatatgtgtgtttttcagtattcaaataagatcaggaagccaattttctatgtatgaatatgctttaacctaggatttcagtccactctgactgactttctaaactttaacttgggtttttacagtgactatgcattagtgctgactctttggtataagccataaaatattttccttcctatcaatttatctgaactttggtcttttcactaaattgtacagtattctacttctgtttaaaacggggagatgagaaagggaatactatctaaccaataacttgaacaaaaacactaaactaagcatttaatagaaatgctttttattgaggaggtattatccagagttcatgcttagaacaaatgcatctttgcgtatcctagacttaacaattcatcagtttctgagaccacagaatcaggttttccgtagtagataaagactctctggtgcttcaaattctgttcaagtgttttgactcatcagcttctactctttctattactgcctttgcctggcttgttttgtctctttgcaactgattttgcaaaaaaaaattgtagctttaaaataacagggtctaagtattttaaatgtgcctatttcacagctctcttggtcacaaaaacatgctatttttattggaacttcaaaccaaatccccactgagtgtgtactggttcctgcaggtagcagtctcctattatctcctgtttagcaccaaaagagctaatattattggaaactgaccttttaaaggccactggcagtaggatttaaaaagcagcccactgctcagtttccaggatcagcttcctccttctgtcacttgtgtaagttggcactaccttgtgcctctcagattgctgaagtgctgctggtaagcatgtgcatgctctgcctttcttgtgaaagttttcaatcagcgatatcagcacttacagtaagaagtaaaagtagtgcacagcaaagctaatttgcctttgcctggggtgttcagcttgaaagaataaagctcatttggtttagttaaatgtcttactctactgtgcctatgcttttagctgcgttactaagcaagggaaaaataacagtttctctgagccagagaagacttgatcacagttctccaagcatcgtgatagcaatgcttaaccccaggaagatttcaaggcagggagaagaacatttcaaataagattcttgttaacccatttatgcctagtgttccattattggaatgctaagcttgtgggagtcatttacatcctactgctcaaagtcattgccaaggtctgatttttcacacaaaaaattgcaacccccagcataaatgggttagctactgtcatcagttagcaaattcatccacacaaacacaattagagtttggtttttttttaagcttttcaaaacttactaaactggcacaattttatatgtatgctatttgttgtatttatgcttaagagcaaaaaagttttgatgggattttaaattcaggcaaagcctacaacgctgagacaatcccctaacaacatggtagtaactaaagaaacttttatactaggcttcttagttttaaaaggaagtggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcatttatcctgtcacatgtttctgtttctatagtaatttagaaattgcaaatagttaacttttcatcatgtaaaaagttaacattatcctatttccatagataccatggacggcggtgtggcctgagttgtcagtctttaatcctgagtcatgtggctctcttttcatctttgatgtcagttccaattatttggcatcaaaaaccttcatggtaggtagagttttaggtaaaagtggatctagggttactttctttattaacatttcctaaataactgaattgagagacatactctgctactatgtcctcaggttaatttttgtctgatcttacgatgccctgccttttactagctactttagaaatagaaaatgtgaagagtgactatttacatgtatactcctttggctgctagaactcatctgtagtcctttattatttacactgaattccaatttcatttctgcttccgctaagtaagagcacctcattcctgtgttttctctactattgagctgtagacgaactgtttctctaattataaagcaaactgtttgggattcatatgtatttctatgttctgtaaagtatttgacttactagttctcaataaaattttattaggactata

SEQ ID NO: 455383 - DNA, 4396 bp, Homo sapiens
ggctgcggggtgagaggccagggccgagaagggcttcaggacgcgggaggcgcacttgcttcaagtcgcgggcgtgggaacggggttgcaaaacggggcctctttgtccgggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaatatgtgactattattgggtattacacttcacttctctttaatatttttcctccaactggagggcagacaattttctgacttgcttttctctaggtggttcattttgaaaggggacagaaatataactaaatgcttccaggagaaaaattccaagagttacaatctggacttggtacctaaatatcattttttaaattcttgatgcctatttggactagaggtaaacatactttcagattggcctgtttttgtcggtaaggcatacagccttcagaagccaacatttttaatcaaaaacttataaaacatgatgatcattgtgaaaattctgagttgaaggttagtttaagataagctaacaataacagtctgtgttttctctaaaataatctgagttttttggaactctttatttaaatatgtgtgtttttcagtattcaaataagatcaggaagccaattttctatgtatgaatatgctttaacctaggatttcagtccactctgactgactttctaaactttaacttgggtttttacagtgactatgcattagtgctgactctttggtataagccataaaatattttccttcctatcaatttatctgaactttggtcttttcactaaattgtacagtattctacttctgtttaaaacggggagatgagaaagggaatactatctaaccaataacttgaacaaaaacactaaactaagcatttaatagaaatgctttttattgaggaggtattatccagagttcatgcttagaacaaatgcatctttgcgtatcctagacttaacaattcatcagtttctgagaccacagaatcaggttttccgtagtagataaagactctctggtgcttcaaattctgttcaagtgttttgactcatcagcttctactctttctattactgcctttgcctggcttgttttgtctctttgcaactgattttgcaaaaaaaaattgtagctttaaaataacagggtctaagtattttaaatgtgcctatttcacagctctcttggtcacaaaaacatgctatttttattggaacttcaaaccaaatccccactgagtgtgtactggttcctgcaggtagcagtctcctattatctcctgtttagcaccaaaagagctaatattattggaaactgaccttttaaaggccactggcagtaggatttaaaaagcagcccactgctcagtttccaggatcagcttcctccttctgtcacttgtgtaagttggcactaccttgtgcctctcagattgctgaagtgctgctggtaagcatgtgcatgctctgcctttcttgtgaaagttttcaatcagcgatatcagcacttacagtaagaagtaaaagtagtgcacagcaaagctaatttgcctttgcctggggtgttcagcttgaaagaataaagctcatttggtttagttaaatgtcttactctactgtgcctatgcttttagctgcgttactaagcaagggaaaaataacagtttctctgagccagagaagacttgatcacagttctccaagcatcgtgatagcaatgcttaaccccaggaagatttcaaggcagggagaagaacatttcaaataagattcttgttaacccatttatgcctagtgttccattattggaatgctaagcttgtgggagtcatttacatcctactgctcaaagtcattgccaaggtctgatttttcacacaaaaaattgcaacccccagcataaatgggttagctactgtcatcagttagcaaattcatccacacaaacacaattagagtttggtttttttttaagcttttcaaaacttactaaactggcacaattttatatgtatgctatttgttgtatttatgcttaagagcaaaaaagttttgatgggattttaaattcaggcaaagcctacaacgctgagacaatcccctaacaacatggtagtaactaaagaaacttttatactaggcttcttagttttaaaaggaagtggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcatttatcctgtcacatgtttctgtttctatagtaatttagaaattgcaaatagttaacttttcatcatgtaaaaagttaacattatcctatttccatagataccatggacggcggtgtggcctgagttgtcagtctttaatcctgagtcatgtggctctcttttcatctttgatgtcagttccaattatttggcatcaaaaaccttcatgtgtgccggaccagtcaaagaatcccacgtcaaaattgagagaacgaacaagccttcatcgcatggcacatttgtataaaaagaaagggagagatgttgcaggaagtcagggaccccaaacagagggaccggctgaagccatggcagaagaacataaattgtgaagatttcatggacatttattagttccccaaattagtacttttataatttcttatgcctgtctttactgcaatctctgaacataaattgtgaagatttaatggacacatcacttccttaatcaatactcttgtgatttcctaaaa

SEQ ID NO: 455384 - DNA, 4336 bp, Homo sapiens
ggctgcggggtgagaggccagggccgagaagggcttcaggacgcgggaggcgcacttgcttcaagtcgcgggcgtgggaacggggttgcaaaacggggcctctttgtccgggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaatatgtgactattattgggtattacacttcacttctctttaatatttttcctccaactggagggcagacaattttctgacttgcttttctctaggtggttcattttgaaaggggacagaaatataactaaatgcttccaggagaaaaattccaagagttacaatctggacttggtacctaaatatcattttttaaattcttgatgcctatttggactagaggtaaacatactttcagattggcctgtttttgtcggtaaggcatacagccttcagaagccaacatttttaatcaaaaacttataaaacatgatgatcattgtgaaaattctgagttgaaggttagtttaagataagctaacaataacagtctgtgttttctctaaaataatctgagttttttggaactctttatttaaatatgtgtgtttttcagtattcaaataagatcaggaagccaattttctatgtatgaatatgctttaacctaggatttcagtccactctgactgactttctaaactttaacttgggtttttacagtgactatgcattagtgctgactctttggtataagccataaaatattttccttcctatcaatttatctgaactttggtcttttcactaaattgtacagtattctacttctgtttaaaacggggagatgagaaagggaatactatctaaccaataacttgaacaaaaacactaaactaagcatttaatagaaatgctttttattgaggaggtattatccagagttcatgcttagaacaaatgcatctttgcgtatcctagacttaacaattcatcagtttctgagaccacagaatcaggttttccgtagtagataaagactctctggtgcttcaaattctgttcaagtgttttgactcatcagcttctactctttctattactgcctttgcctggcttgttttgtctctttgcaactgattttgcaaaaaaaaattgtagctttaaaataacagggtctaagtattttaaatgtgcctatttcacagctctcttggtcacaaaaacatgctatttttattggaacttcaaaccaaatccccactgagtgtgtactggttcctgcaggtagcagtctcctattatctcctgtttagcaccaaaagagctaatattattggaaactgaccttttaaaggccactggcagtaggatttaaaaagcagcccactgctcagtttccaggatcagcttcctccttctgtcacttgtgtaagttggcactaccttgtgcctctcagattgctgaagtgctgctggtaagcatgtgcatgctctgcctttcttgtgaaagttttcaatcagcgatatcagcacttacagtaagaagtaaaagtagtgcacagcaaagctaatttgcctttgcctggggtgttcagcttgaaagaataaagctcatttggtttagttaaatgtcttactctactgtgcctatgcttttagctgcgttactaagcaagggaaaaataacagtttctctgagccagagaagacttgatcacagttctccaagcatcgtgatagcaatgcttaaccccaggaagatttcaaggcagggagaagaacatttcaaataagattcttgttaacccatttatgcctagtgttccattattggaatgctaagcttgtgggagtcatttacatcctactgctcaaagtcattgccaaggtctgatttttcacacaaaaaattgcaacccccagcataaatgggttagctactgtcatcagttagcaaattcatccacacaaacacaattagagtttggtttttttttaagcttttcaaaacttactaaactggcacaattttatatgtatgctatttgttgtatttatgcttaagagcaaaaaagttttgatgggattttaaattcaggcaaagcctacaacgctgagacaatcccctaacaacatggtagtaactaaagaaacttttatactaggcttcttagttttaaaaggaagtggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcatttatcctgtcacatgtttctgtttctatagtaatttagaaattgcaaatagttaacttttcatcttgtcagtctttaatcctgagtcatgtggctctcttttcatctttgatgtcagttccaattatttggcatcaaaaaccttcatgtgtgccggaccagtcaaagaatcccacgtcaaaattgagagaacgaacaagccttcatcgcatggcacatttgtataaaaagaaagggagagatgttgcaggaagtcagggaccccaaacagagggaccggctgaagccatggcagaagaacataaattgtgaagatttcatggacatttattagttccccaaattagtacttttataatttcttatgcctgtctttactgcaatctctgaacataaattgtgaagatttaatggacacatcacttccttaatcaatactcttgtgatttcctaaaa

SEQ ID NO: 455385 - DNA, 4503 bp, Homo sapiens
ggctgcggggtgagaggccagggccgagaagggcttcaggacgcgggaggcgcacttgcttcaagtcgcgggcgtgggaacggggttgcaaaacggggcctctttgtccgggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaatatgtgactattattgggtattacacttcacttctctttaatatttttcctccaactggagggcagacaattttctgacttgcttttctctaggtggttcattttgaaaggggacagaaatataactaaatgcttccaggagaaaaattccaagagttacaatctggacttggtacctaaatatcattttttaaattcttgatgcctatttggactagaggtaaacatactttcagattggcctgtttttgtcggtaaggcatacagccttcagaagccaacatttttaatcaaaaacttataaaacatgatgatcattgtgaaaattctgagttgaaggttagtttaagataagctaacaataacagtctgtgttttctctaaaataatctgagttttttggaactctttatttaaatatgtgtgtttttcagtattcaaataagatcaggaagccaattttctatgtatgaatatgctttaacctaggatttcagtccactctgactgactttctaaactttaacttgggtttttacagtgactatgcattagtgctgactctttggtataagccataaaatattttccttcctatcaatttatctgaactttggtcttttcactaaattgtacagtattctacttctgtttaaaacggggagatgagaaagggaatactatctaaccaataacttgaacaaaaacactaaactaagcatttaatagaaatgctttttattgaggaggtattatccagagttcatgcttagaacaaatgcatctttgcgtatcctagacttaacaattcatcagtttctgagaccacagaatcaggttttccgtagtagataaagactctctggtgcttcaaattctgttcaagtgttttgactcatcagcttctactctttctattactgcctttgcctggcttgttttgtctctttgcaactgattttgcaaaaaaaaattgtagctttaaaataacagggtctaagtattttaaatgtgcctatttcacagctctcttggtcacaaaaacatgctatttttattggaacttcaaaccaaatccccactgagtgtgtactggttcctgcaggtagcagtctcctattatctcctgtttagcaccaaaagagctaatattattggaaactgaccttttaaaggccactggcagtaggatttaaaaagcagcccactgctcagtttccaggatcagcttcctccttctgtcacttgtgtaagttggcactaccttgtgcctctcagattgctgaagtgctgctggtaagcatgtgcatgctctgcctttcttgtgaaagttttcaatcagcgatatcagcacttacagtaagaagtaaaagtagtgcacagcaaagctaatttgcctttgcctggggtgttcagcttgaaagaataaagctcatttggtttagttaaatgtcttactctactgtgcctatgcttttagctgcgttactaagcaagggaaaaataacagtttctctgagccagagaagacttgatcacagttctccaagcatcgtgatagcaatgcttaaccccaggaagatttcaaggcagggagaagaacatttcaaataagattcttgttaacccatttatgcctagtgttccattattggaatgctaagcttgtgggagtcatttacatcctactgctcaaagtcattgccaaggtctgatttttcacacaaaaaattgcaacccccagcataaatgggttagctactgtcatcagttagcaaattcatccacacaaacacaattagagtttggtttttttttaagcttttcaaaacttactaaactggcacaattttatatgtatgctatttgttgtatttatgcttaagagcaaaaaagttttgatgggattttaaattcaggcaaagcctacaacgctgagacaatcccctaacaacatggtagtaactaaagaaacttttatactaggcttcttagttttaaaaggaagtggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcatttatcctgtcacatgtttctgtttctatagtaatttagaaattgcaaatagttaacttttcatcttgtcagtctttaatcctgagtcatgtggctctcttttcatctttgatgtcagttccaattatttggcatcaaaaaccttcatggtaggtagagttttaggtaaaagtggatctagggttactttctttattaacatttcctaaataactgaattgagagacatactctgctactatgtcctcaggttaatttttgtctgatcttacgatgccctgccttttactagctactttagaaatagaaaatgtgaagagtgactatttacatgtatactcctttggctgctagaactcatctgtagtcctttattatttacactgaattccaatttcatttctgcttccgctaagtaagagcacctcattcctgtgttttctctactattgagctgtagacgaactgtttctctaattataaagcaaactgtttgggatattcagggaaactaccccaatgttatgttgtcatttaatgggaaaggctgggatcatatgtatttctatgttctgtaaagtatttgacttactagttctcaataaaattttattaggactata

SEQ ID NO: 455386 - DNA, 4536 bp, Homo sapiens
ggctgcggggtgagaggccagggccgagaagggcttcaggacgcgggaggcgcacttgcttcaagtcgcgggcgtgggaacggggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaatatgtgactattattgggtattacacttcacttctctttaatatttttcctccaactggagggcagacaattttctgacttgcttttctctaggtggttcattttgaaaggggacagaaatataactaaatgcttccaggagaaaaattccaagagttacaatctggacttggtacctaaatatcattttttaaattcttgatgcctatttggactagaggtaaacatactttcagattggcctgtttttgtcggtaaggcatacagccttcagaagccaacatttttaatcaaaaacttataaaacatgatgatcattgtgaaaattctgagttgaaggttagtttaagataagctaacaataacagtctgtgttttctctaaaataatctgagttttttggaactctttatttaaatatgtgtgtttttcagtattcaaataagatcaggaagccaattttctatgtatgaatatgctttaacctaggatttcagtccactctgactgactttctaaactttaacttgggtttttacagtgactatgcattagtgctgactctttggtataagccataaaatattttccttcctatcaatttatctgaactttggtcttttcactaaattgtacagtattctacttctgtttaaaacggggagatgagaaagggaatactatctaaccaataacttgaacaaaaacactaaactaagcatttaatagaaatgctttttattgaggaggtattatccagagttcatgcttagaacaaatgcatctttgcgtatcctagacttaacaattcatcagtttctgagaccacagaatcaggttttccgtagtagataaagactctctggtgcttcaaattctgttcaagtgttttgactcatcagcttctactctttctattactgcctttgcctggcttgttttgtctctttgcaactgattttgcaaaaaaaaattgtagctttaaaataacagggtctaagtattttaaatgtgcctatttcacagctctcttggtcacaaaaacatgctatttttattggaacttcaaaccaaatccccactgagtgtgtactggttcctgcaggtagcagtctcctattatctcctgtttagcaccaaaagagctaatattattggaaactgaccttttaaaggccactggcagtaggatttaaaaagcagcccactgctcagtttccaggatcagcttcctccttctgtcacttgtgtaagttggcactaccttgtgcctctcagattgctgaagtgctgctggtaagcatgtgcatgctctgcctttcttgtgaaagttttcaatcagcgatatcagcacttacagtaagaagtaaaagtagtgcacagcaaagctaatttgcctttgcctggggtgttcagcttgaaagaataaagctcatttggtttagttaaatgtcttactctactgtgcctatgcttttagctgcgttactaagcaagggaaaaataacagtttctctgagccagagaagacttgatcacagttctccaagcatcgtgatagcaatgcttaaccccaggaagatttcaaggcagggagaagaacatttcaaataagattcttgttaacccatttatgcctagtgttccattattggaatgctaagcttgtgggagtcatttacatcctactgctcaaagtcattgccaaggtctgatttttcacacaaaaaattgcaacccccagcataaatgggttagctactgtcatcagttagcaaattcatccacacaaacacaattagagtttggtttttttttaagcttttcaaaacttactaaactggcacaattttatatgtatgctatttgttgtatttatgcttaagagcaaaaaagttttgatgggattttaaattcaggcaaagcctacaacgctgagacaatcccctaacaacatggtagtaactaaagaaacttttatactaggcttcttagttttaaaaggaagtggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcatttatcctgtcacatgtttctgtttctatagtaatttagaaattgcaaatagttaacttttcatcatgtaaaaagttaacattatcctatttccatagataccatggacggcggtgtggcctgagttgtcagtctttaatcctgagtcatgtggctctcttttcatctttgatgtcagttccaattatttggcatcaaaaaccttcatggtaggtagagttttaggtaaaagtggatctagggttactttctttattaacatttcctaaataactgaattgagagacatactctgctactatgtcctcaggttaatttttgtctgatcttacgatgccctgccttttactagctactttagaaatagaaaatgtgaagagtgactatttacatgtatactcctttggctgctagaactcatctgtagtcctttattatttacactgaattccaatttcatttctgcttccgctaagtaagagcacctcattcctgtgttttctctactattgagctgtagacgaactgtttctctaattataaagcaaactgtttgggatattcagggaaactaccccaatgttatgttgtcatttaatgggaaaggctgggatcatatgtatttctatgttctgtaaagtatttgacttactagttctcaataaaattttattaggactata

SEQ ID NO: 455387 - DNA, 4478 bp, Homo sapiens
aggagtagagtttgggatggcagcctcagaaggacaaacttaggccaaggagggagggagttggggtggagactgagcttctccagttggaggtctggagctaggactcttcattgaaaccggagagaaggaaaaggagagagtgaggctgactttttaactgaactccaaaattctctgagcaatagaatgggcctaatatgtaccaggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaatatgtgactattattgggtattacacttcacttctctttaatatttttcctccaactggagggcagacaattttctgacttgcttttctctaggtggttcattttgaaaggggacagaaatataactaaatgcttccaggagaaaaattccaagagttacaatctggacttggtacctaaatatcattttttaaattcttgatgcctatttggactagaggtaaacatactttcagattggcctgtttttgtcggtaaggcatacagccttcagaagccaacatttttaatcaaaaacttataaaacatgatgatcattgtgaaaattctgagttgaaggttagtttaagataagctaacaataacagtctgtgttttctctaaaataatctgagttttttggaactctttatttaaatatgtgtgtttttcagtattcaaataagatcaggaagccaattttctatgtatgaatatgctttaacctaggatttcagtccactctgactgactttctaaactttaacttgggtttttacagtgactatgcattagtgctgactctttggtataagccataaaatattttccttcctatcaatttatctgaactttggtcttttcactaaattgtacagtattctacttctgtttaaaacggggagatgagaaagggaatactatctaaccaataacttgaacaaaaacactaaactaagcatttaatagaaatgctttttattgaggaggtattatccagagttcatgcttagaacaaatgcatctttgcgtatcctagacttaacaattcatcagtttctgagaccacagaatcaggttttccgtagtagataaagactctctggtgcttcaaattctgttcaagtgttttgactcatcagcttctactctttctattactgcctttgcctggcttgttttgtctctttgcaactgattttgcaaaaaaaaattgtagctttaaaataacagggtctaagtattttaaatgtgcctatttcacagctctcttggtcacaaaaacatgctatttttattggaacttcaaaccaaatccccactgagtgtgtactggttcctgcaggtagcagtctcctattatctcctgtttagcaccaaaagagctaatattattggaaactgaccttttaaaggccactggcagtaggatttaaaaagcagcccactgctcagtttccaggatcagcttcctccttctgtcacttgtgtaagttggcactaccttgtgcctctcagattgctgaagtgctgctggtaagcatgtgcatgctctgcctttcttgtgaaagttttcaatcagcgatatcagcacttacagtaagaagtaaaagtagtgcacagcaaagctaatttgcctttgcctggggtgttcagcttgaaagaataaagctcatttggtttagttaaatgtcttactctactgtgcctatgcttttagctgcgttactaagcaagggaaaaataacagtttctctgagccagagaagacttgatcacagttctccaagcatcgtgatagcaatgcttaaccccaggaagatttcaaggcagggagaagaacatttcaaataagattcttgttaacccatttatgcctagtgttccattattggaatgctaagcttgtgggagtcatttacatcctactgctcaaagtcattgccaaggtctgatttttcacacaaaaaattgcaacccccagcataaatgggttagctactgtcatcagttagcaaattcatccacacaaacacaattagagtttggtttttttttaagcttttcaaaacttactaaactggcacaattttatatgtatgctatttgttgtatttatgcttaagagcaaaaaagttttgatgggattttaaattcaggcaaagcctacaacgctgagacaatcccctaacaacatggtagtaactaaagaaacttttatactaggcttcttagttttaaaaggaagtggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcatttatcctgtcacatgtttctgtttctatagtaatttagaaattgcaaatagttaacttttcatcatgtaaaaagttaacattatcctatttccatagataccatggacggcggtgtggcctgagttgtcagtctttaatcctgagtcatgtggctctcttttcatctttgatgtcagttccaattatttggcatcaaaaaccttcatggtaggtagagttttaggtaaaagtggatctagggttactttctttattaacatttcctaaataactgaattgagagacatactctgctactatgtcctcaggttaatttttgtctgatcttacgatgccctgccttttactagctactttagaaatagaaaatgtgaagagtgactatttacatgtatactcctttggctgctagaactcatctgtagtcctttattatttacactgaattccaatttcatttctgcttccgctaagtaagagcacctcattcctgtgttttctctactattgagctgtagacgaactgtttctctaattataaagcaaactgtttgggatattcagggaaactaccccaatgttatgttgtcatttaatgggaaaggctgggatcatatgtatttctatgttctgtaaagtatttgacttactagttctcaataaaattttattaggactata

SEQ ID NO: 455388 - DNA, 4086 bp, Homo sapiens
ggctgcggggtgagaggccagggccgagaagggcttcaggacgcgggaggcgcacttgcttcaagtcgcgggcgtgggaacggggttgcaaaacggggcctctttgtccgggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaatatgtgactattattgggtattacacttcacttctctttaatatttttcctccaactggagggcagacaattttctgacttgcttttctctaggtggttcattttgaaaggggacagaaatataactaaatgcttccaggagaaaaattccaagagttacaatctggacttggtacctaaatatcattttttaaattcttgatgcctatttggactagaggtaaacatactttcagattggcctgtttttgtcggtaaggcatacagccttcagaagccaacatttttaatcaaaaacttataaaacatgatgatcattgtgaaaattctgagttgaaggttagtttaagataagctaacaataacagtctgtgttttctctaaaataatctgagttttttggaactctttatttaaatatgtgtgtttttcagtattcaaataagatcaggaagccaattttctatgtatgaatatgctttaacctaggatttcagtccactctgactgactttctaaactttaacttgggtttttacagtgactatgcattagtgctgactctttggtataagccataaaatattttccttcctatcaatttatctgaactttggtcttttcactaaattgtacagtattctacttctgtttaaaacggggagatgagaaagggaatactatctaaccaataacttgaacaaaaacactaaactaagcatttaatagaaatgctttttattgaggaggtattatccagagttcatgcttagaacaaatgcatctttgcgtatcctagacttaacaattcatcagtttctgagaccacagaatcaggttttccgtagtagataaagactctctggtgcttcaaattctgttcaagtgttttgactcatcagcttctactctttctattactgcctttgcctggcttgttttgtctctttgcaactgattttgcaaaaaaaaattgtagctttaaaataacagggtctaagtattttaaatgtgcctatttcacagctctcttggtcacaaaaacatgctatttttattggaacttcaaaccaaatccccactgagtgtgtactggttcctgcaggtagcagtctcctattatctcctgtttagcaccaaaagagctaatattattggaaactgaccttttaaaggccactggcagtaggatttaaaaagcagcccactgctcagtttccaggatcagcttcctccttctgtcacttgtgtaagttggcactaccttgtgcctctcagattgctgaagtgctgctggtaagcatgtgcatgctctgcctttcttgtgaaagttttcaatcagcgatatcagcacttacagtaagaagtaaaagtagtgcacagcaaagctaatttgcctttgcctggggtgttcagcttgaaagaataaagctcatttggtttagttaaatgtcttactctactgtgcctatgcttttagctgcgttactaagcaagggaaaaataacagtttctctgagccagagaagacttgatcacagttctccaagcatcgtgatagcaatgcttaaccccaggaagatttcaaggcagggagaagaacatttcaaataagattcttgttaacccatttatgcctagtgttccattattggaatgctaagcttgtgggagtcatttacatcctactgctcaaagtcattgccaaggtctgatttttcacacaaaaaattgcaacccccagcataaatgggttagctactgtcatcagttagcaaattcatccacacaaacacaattagagtttggtttttttttaagcttttcaaaacttactaaactggcacaattttatatgtatgctatttgttgtatttatgcttaagagcaaaaaagttttgatgggattttaaattcaggcaaagcctacaacgctgagacaatcccctaacaacatggtagtaactaaagaaacttttatactaggcttcttagttttaaaaggaagtggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcatttatcctgtcacatgtttctgtttctatagtaatttagaaattgcaaatagttaacttttcatcatgtaaaaagttaacattatcctatttccatagataccatggacggcggtgtggcctgagttgtcagtctttaatcctagatccacttttacctaaaactctacctaccatgaaggtttttgatgccaaataattggaacg

SEQ ID NO: 455389 - DNA, 328 bp, Homo sapiens
gcgtcatggctcaaagggccttcccgaatccttatgctgattataacaaatccctggccgaaggctactttgatgctgccgggagggtgagtttaggatatgtctgcctgcatccctgcctctccccacggtgttcggaaaggtgctcatttttgcctgagagagttgagcatccccctttaaaaaaatacatgattcgacgataaatacgtaaattatttaaaaatacatgttaatatatacaaattgagctctaacataatgttaaatgtgtcattgttaacattattaattgaaataaactcaattattgatagtataaatttta

SEQ ID NO: 455390 - DNA, 5191 bp, Homo sapiens
tgcaggagactgcgagccctgcagaactgctagctgcgggggagagggcaggggtcgggcgcctgtggcggagccgggctggggccagggcagggaggctgacaagcggcgggagaagccggcggagggcgggatcgcgcctcctgacatgttgggggtatccctggccgggccgggccggggctaagagcggcgctgcgggccggggtcggggtcgggtcgcggtccgcccccgctgtccctccgtcctgccctgtcgaggacgtgcgttccgcactcggccgcctccagagggagcgagggaagcggctagaggatcggggagaaggagcattcgccggaggctggaggaggctgacccgcgtccccgcccagcctgctcctatgcggtacttgaaggatggcgaagaggtcgcgcagtgaggatgaggatgatgaccttcagtatgccgatcatgattatgaagtaccacaacaaaaaggactgaagaaactctggaacagagtaaaatggacaagggacgaggatgataaattaaagaagttggttgaacaacatggaactgatgattggactctaattgctagtcatcttcaaaatcgctctgattttcagtgccagcatcgatggcagaaagttttaaatcctgaattgataaagggtccttggactaaagaagaagatcagagggttattgaattagttcagaaatatgggccaaaaagatggtctttaattgcaaaacatttaaaaggaagaataggcaagcagtgtagagaaagatggcataatcatctgaatcctgaggtaaagaaatcttcctggacagaagaggaggacaggatcatctatgaagcacataagcggttgggaaatcgttgggcagaaattgccaaactacttccaggaaggactgataattctatcaaaaatcattggaattctactatgcgaagaaaagtggaacaggagggctatttacaagatggaataaaatcagaacgatcttcatctaaacttcaacacaaaccttgtgcagctatggatcatatgcaaacccagaatcagttttacatacctgttcagatccctgggtatcagtatgtgtcacctgaaggcaattgtatagaacatgttcagcctacttctgcctttattcagcaacccttcattgatgaagatcctgataaggaaaagaaaataaaggaacttgagatgcttcttatgtcagctgagaatgaagttagaagaaagcgaattccatcacagcctggaagtttttctagctggtctggtagtttcctcatggatgataacatgtctaatactctaaatagccttgacgagcacactagtgagttttacagtatggatgaaaatcagcctgtgtctgctcagcagaattcacccacaaagttcctggccgtggaggcaaacgctgtgttatcctctttgcagaccatcccagaatttgcagagactctagaacttattgaatctgatcctgtagcatggagtgacgttaccagttttgatatttctgatgctgctgcttctcctatcaaatccaccccagttaaattaatgagaattcagcacaatgaaggagccatggaatgccaatttaacgtcagtcttgtacttgaagggaaaaaaaacacttgtaatggtggcaacagtgaagctgttcctttaacatccccaaatatagccaagtttagcactccaccagccatcctcagaaagaagagaaaaatgcgagtgggtcattccccaggcagcgaacttagggatggctcattgaacgatggtggtaatatggcgctaaaacatacaccactgaaaacactaccattttctccttcacagtttttcaacacatgtcctggtaatgaacaacttaatatagaaaatccttcatttacatcaacccctatttgtgggcagaaagctctcattacaactcctcttcataaggaaacaactcccaaagatcaaaaggaaaatgtagggtttagaacacctactattagaagatctatactgggtaccacaccaagaactcctactccttttaagaatgcgcttgctgctcaggagaaaaaatatggacctcttaaaattgtgtcccagccacttgctttcttggaagaagatattcgggaagttttaaaagaagaaactggaacagacctattcctcaaagaggaagatgaacctgcttacaaaagctgcaaacaagagaataccgcttctgggaagaaagtcagaaaatcactagtcttagataattgggaaaaagaagaatcaggcactcaactgttgactgaagacatttcagacatgcagtcagaaaatagatttactacatccttattaatgataccattattggaaatacatgacaataggtgcaacttgattcctgaaaaacaagatataaattcaaccaacaaaacatatacacttactaaaaagaaaccaaaccctaacacttccaaagttgtcaaattggaaaagaatcttcagtcaaattgtgaatgggaaacagtggtttatgggaagacagaagaccaacttattatgactgaacaagcaagaagatatctgagtacttacacagctaccagtagtacttcaagagctctcatactgtaattgttattaaaattgatgaaatgccccactcccttactgcagtctctactaaattaggttgcagtgaaatttttctcaattagttgtttttaaagttgtaagatagcccttttaatacagcatcttttttctattctatatagtaggcagaaagctagtaagtcacttaaggggtagatagtttcatagtttattttttaagagatgagatttttaaaaattgtttttaaagaacaagatgggaaaataatagaatgttcatggatttctaaaagtaaattctcatatattttcttcacaagatatatgttgctactctcttgatgctgcagttttgttatagataggtgtatgagtatatatgatttctgaaattagtctatgtatggaaagcacacatgattttatgaagtacttttgcccatgtgctgatttacttaggctaccatttacaaagaaacacattgaaaaggaatttaaaggaaggatagaaagttgcactactaattttttgttttttttttcagaagcagtaaaattaactacagtgttaaatgtatttatttgagcatagtactgaaaacaaaaagcattcaaaaaagagttttttctttattagtaaatagtattttcttaatctcagaggagctgagagttttgttgaatgtattgtacagtatgtaggagcaggagaactttgtaaattggaaagaagtctgtttttataatttatttttatttttaaagcttaaatgtagatatttatacgtatacagggtgcctagaagccaatgttgtttcctgttattacagctaacacagtaaagaataattttgactttaagtatgaaacagtagtaagttatagctgcaaagaatacaatatctatactgtatgtcacatctacctaaatgttgcactatgccctttaaatcatgctggttataaagtagttctaaaaatgtactaaataataatttaatattttctttttaaattatatcgggggtggtcatatacattaatctggtgatttgtatatgtgtttgaaatttttgcattttgtttaaaaaataatatggtaccttggtccctaaaaacagtctgcacttagaagtttatatttactcagtgtttcagaagtggagaacattatcttttatttataaaaatattttgtccttttttaaatgttttgtgtttctctacaggttacaacagttgcttcagttgcctgttttaggtgtttgcacttattttatttcttcttgaaagaatttttatttgcttttgtggtagagattatatgtaattttttttcagtcatataatggtgtgctgtcaacttaaacactgacaggtaaatagaattgtacactgtagtttgaattatttataattgacacactctctccctctccactcctgaagtatgctgctatagaaaatagcagaatcggcttgctgctacgagagaaggaaagagcgaccaccacttgcactgtgtgaaaagataaaaaacaaatgatggcaagttctcaagttaactaaatggaatcaaccattaccaggcaaattcttgcaaataccaaaatactactatgccttataaaacaaaatgaaagcaggttaagattttctgctctgtttgtatgttaatagaaatggaaatactaagtattttaatgcttagctcttgaacagtagacctaaaagggttttaagctatttaaatctacttgctagtttttgcatattttatatatatatatatttatatatatatatagtgagaagtgaagaaaatgtatggtactaagattatgccttattgataaatagataaaccaatttgaatcctcttagcatgtttaagtatgttgattgctttctaattaatgaacttctcacagaaatttcacttagtgaaaccaatgattgtagcaaactcatactggatcatttcagttaccttgaactaatagcacataatggttttttgttgttgttgtttttaatgtagcccttacctggatatacatagtctgcaatcaccaaagtataatatcttgtaaggctatattttttaaagcatattttttcttgagcattaaattatcctaaatggtaatatattgtggataagtctgggcttattggacataatacatatttgggttggtactggttgaatccttcagttaactgctttgttgctttttgcaagattttttatcttaaacatgtcaggcatcttaagtcacctttatactgttttgttcctctgagtttctttcagtatgttatacaaatgccagacataacatgtagcagccatacttgcatggaaactgactacacatacataatactgcattttattgtaaggttttcacattaatacagcaattaccctgactaaattgagttttgtgatatatggaaaacttcattgtaagagaatcttgcatacaatgttgacatattaacatccaaaataaagcatctgtgtacaagctgaaaaaaaaaaa

SEQ ID NO: 455391 - DNA, 5361 bp, Homo sapiens
tgcaggagactgcgagccctgcagaactgctagctgcgggggagagggcaggggtcgggcgcctgtggcggagccgggctggggccagggcagggaggctgacaagcggcgggagaagccggcggagggcgggatcgcgcctcctgacatgttgggggtatccctggccgggccgggccggggctaagagcggcgctgcgggccggggtcggggtcgggtcgcggtccgcccccgctgtccctccgtcctgccctgtcgaggacgtgcgttccgcactcggccgcctccagagggagcgagggaagcggctagaggatcggggagaaggagcattcgccggaggctggaggaggctgacccgcgtccccgcccagcctgctcctatgcggtacttgaaggatggcgaagaggtcgcgcaggtgggtggcacccctttcgcccaggcctgtcggcgccgtctcggctcagattctctttcctatcccgctgccccctcccgccataaggccctccctggcgagggcagaggtttttcttcccgcgtccccgcggccgcttggcctcgatgaccggagggcagctgcgacgtgtggagagttggggaccagggtgtttgaggcgcgggacgtaagagatgcccaggtttctcggtgactctccccgtaatgcgcgtccagatttctgacctcatgctgccacttcttcgaggcaggtttcttgccagtgaggatgaggatgatgaccttcagtatgccgatcatgattatgaagtaccacaacaaaaaggactgaagaaactctggaacagagtaaaatggacaagggacgaggatgataaattaaagaagttggttgaacaacatggaactgatgattggactctaattgctagtcatcttcaaaatcgctctgattttcagtgccagcatcgatggcagaaagttttaaatcctgaattgataaagggtccttggactaaagaagaagatcagagggttattgaattagttcagaaatatgggccaaaaagatggtctttaattgcaaaacatttaaaaggaagaataggcaagcagtgtagagaaagatggcataatcatctgaatcctgaggtaaagaaatcttcctggacagaagaggaggacaggatcatctatgaagcacataagcggttgggaaatcgttgggcagaaattgccaaactacttccaggaaggactgataattctatcaaaaatcattggaattctactatgcgaagaaaagtggaacaggagggctatttacaagatggaataaaatcagaacgatcttcatctaaacttcaacacaaaccttgtgcagctatggatcatatgcaaacccagaatcagttttacatacctgttcagatccctgggtatcagtatgtgtcacctgaaggcaattgtatagaacatgttcagcctacttctgcctttattcagcaacccttcattgatgaagatcctgataaggaaaagaaaataaaggaacttgagatgcttcttatgtcagctgagaatgaagttagaagaaagcgaattccatcaaattcacccacaaagttcctggccgtggaggcaaacgctgtgttatcctctttgcagaccatcccagaatttgcagagactctagaacttattgaatctgatcctgtagcatggagtgacgttaccagttttgatatttctgatgctgctgcttctcctatcaaatccaccccagttaaattaatgagaattcagcacaatgaaggagccatggaatgccaatttaacgtcagtcttgtacttgaagggaaaaaaaacacttgtaatggtggcaacagtgaagctgttcctttaacatccccaaatatagccaagtttagcactccaccagccatcctcagaaagaagagaaaaatgcgagtgggtcattccccaggcagcgaacttagggatggctcattgaacgatggtggtaatatggcgctaaaacatacaccactgaaaacactaccattttctccttcacagtttttcaacacatgtcctggtaatgaacaacttaatatagaaaatccttcatttacatcaacccctatttgtgggcagaaagctctcattacaactcctcttcataaggaaacaactcccaaagatcaaaaggaaaatgtagggtttagaacacctactattagaagatctatactgggtaccacaccaagaactcctactccttttaagaatgcgcttgctgctcaggagaaaaaatatggacctcttaaaattgtgtcccagccacttgctttcttggaagaagatattcgggaagttttaaaagaagaaactggaacagacctattcctcaaagaggaagatgaacctgcttacaaaagctgcaaacaagagaataccgcttctgggaagaaagtcagaaaatcactagtcttagataattgggaaaaagaagaatcaggcactcaactgttgactgaagacatttcagacatgcagtcagaaaatagatttactacatccttattaatgataccattattggaaatacatgacaataggtgcaacttgattcctgaaaaacaagatataaattcaaccaacaaaacatatacacttactaaaaagaaaccaaaccctaacacttccaaagttgtcaaattggaaaagaatcttcagtcaaattgtgaatgggaaacagtggtttatgggaagacagaagaccaacttattatgactgaacaagcaagaagatatctgagtacttacacagctaccagtagtacttcaagagctctcatactgtaattgttattaaaattgatgaaatgccccactcccttactgcagtctctactaaattaggttgcagtgaaatttttctcaattagttgtttttaaagttgtaagatagcccttttaatacagcatcttttttctattctatatagtaggcagaaagctagtaagtcacttaaggggtagatagtttcatagtttattttttaagagatgagatttttaaaaattgtttttaaagaacaagatgggaaaataatagaatgttcatggatttctaaaagtaaattctcatatattttcttcacaagatatatgttgctactctcttgatgctgcagttttgttatagataggtgtatgagtatatatgatttctgaaattagtctatgtatggaaagcacacatgattttatgaagtacttttgcccatgtgctgatttacttaggctaccatttacaaagaaacacattgaaaaggaatttaaaggaaggatagaaagttgcactactaattttttgttttttttttcagaagcagtaaaattaactacagtgttaaatgtatttatttgagcatagtactgaaaacaaaaagcattcaaaaaagagttttttctttattagtaaatagtattttcttaatctcagaggagctgagagttttgttgaatgtattgtacagtatgtaggagcaggagaactttgtaaattggaaagaagtctgtttttataatttatttttatttttaaagcttaaatgtagatatttatacgtatacagggtgcctagaagccaatgttgtttcctgttattacagctaacacagtaaagaataattttgactttaagtatgaaacagtagtaagttatagctgcaaagaatacaatatctatactgtatgtcacatctacctaaatgttgcactatgccctttaaatcatgctggttataaagtagttctaaaaatgtactaaataataatttaatattttctttttaaattatatcgggggtggtcatatacattaatctggtgatttgtatatgtgtttgaaatttttgcattttgtttaaaaaataatatggtaccttggtccctaaaaacagtctgcacttagaagtttatatttactcagtgtttcagaagtggagaacattatcttttatttataaaaatattttgtccttttttaaatgttttgtgtttctctacaggttacaacagttgcttcagttgcctgttttaggtgtttgcacttattttatttcttcttgaaagaatttttatttgcttttgtggtagagattatatgtaattttttttcagtcatataatggtgtgctgtcaacttaaacactgacaggtaaatagaattgtacactgtagtttgaattatttataattgacacactctctccctctccactcctgaagtatgctgctatagaaaatagcagaatcggcttgctgctacgagagaaggaaagagcgaccaccacttgcactgtgtgaaaagataaaaaacaaatgatggcaagttctcaagttaactaaatggaatcaaccattaccaggcaaattcttgcaaataccaaaatactactatgccttataaaacaaaatgaaagcaggttaagattttctgctctgtttgtatgttaatagaaatggaaatactaagtattttaatgcttagctcttgaacagtagacctaaaagggttttaagctatttaaatctacttgctagtttttgcatattttatatatatatatatttatatatatatatagtgagaagtgaagaaaatgtatggtactaagattatgccttattgataaatagataaaccaatttgaatcctcttagcatgtttaagtatgttgattgctttctaattaatgaacttctcacagaaatttcacttagtgaaaccaatgattgtagcaaactcatactggatcatttcagttaccttgaactaatagcacataatggttttttgttgttgttgtttttaatgtagcccttacctggatatacatagtctgcaatcaccaaagtataatatcttgtaaggctatattttttaaagcatattttttcttgagcattaaattatcctaaatggtaatatattgtggataagtctgggcttattggacataatacatatttgggttggtactggttgaatccttcagttaactgctttgttgctttttgcaagattttttatcttaaacatgtcaggcatcttaagtcacctttatactgttttgttcctctgagtttctttcagtatgttatacaaatgccagacataacatgtagcagccatacttgcatggaaactgactacacatacataatactgcattttattgtaaggttttcacattaatacagcaattaccctgactaaattgagttttgtgatatatggaaaacttcattgtaagagaatcttgcatacaatgttgacatattaacatccaaaataaagcatctgtgtacaagctgaaaaaaaaaaa

SEQ ID NO: 455392 - DNA, 4015 bp, Homo sapiens
tgtttttagcctaattgaaatgtgttgaaatctgaatttatgcctacattgagaatgacaaataatattcaaatttcttttgtacctttagcagcctggaagtttttctagctggtctggtagtttcctcatggatgataacatgtctaatactctaaatagccttgacgagcacactagtgagttttacagtatggatgaaaatcagcctgtgtctgctcagcagaattcacccacaaagttcctggccgtggaggcaaacgctgtgttatcctctttgcagaccatcccagaatttgcagagactctagaacttattgaatctgatcctgtagcatggagtgacgttaccagttttgatatttctgatgctgctgcttctcctatcaaatccaccccagttaaattaatgagaattcagcacaatgaaggagccatggaatgccaatttaacgtcagtcttgtacttgaagggaaaaaaaacacttgtaatggtggcaacagtgaagctgttcctttaacatccccaaatatagccaagtttagcactccaccagccatcctcagaaagaagagaaaaatgcgagtgggtcattccccaggcagcgaacttagggatggctcattgaacgatggtggtaatatggcgctaaaacatacaccactgaaaacactaccattttctccttcacagtttttcaacacatgtcctggtaatgaacaacttaatatagaaaatccttcatttacatcaacccctatttgtgggcagaaagctctcattacaactcctcttcataaggaaacaactcccaaagatcaaaaggaaaatgtagggtttagaacacctactattagaagatctatactgggtaccacaccaagaactcctactccttttaagaatgcgcttgctgctcaggagaaaaaatatggacctcttaaaattgtgtcccagccacttgctttcttggaagaagatattcgggaagttttaaaagaagaaactggaacagacctattcctcaaagaggaagatgaacctgcttacaaaagctgcaaacaagagaataccgcttctgggaagaaagtcagaaaatcactagtcttagataattgggaaaaagaagaatcaggcactcaactgttgactgaagacatttcagacatgcagtcagaaaatagatttactacatccttattaatgataccattattggaaatacatgacaataggtgcaacttgattcctgaaaaacaagatataaattcaaccaacaaaacatatacacttactaaaaagaaaccaaaccctaacacttccaaagttgtcaaattggaaaagaatcttcagtcaaattgtgaatgggaaacagtggtttatgggaagacagaagaccaacttattatgactgaacaagcaagaagatatctgagtacttacacagctaccagtagtacttcaagagctctcatactgtaattgttattaaaattgatgaaatgccccactcccttactgcagtctctactaaattaggttgcagtgaaatttttctcaattagttgtttttaaagttgtaagatagcccttttaatacagcatcttttttctattctatatagtaggcagaaagctagtaagtcacttaaggggtagatagtttcatagtttattttttaagagatgagatttttaaaaattgtttttaaagaacaagatgggaaaataatagaatgttcatggatttctaaaagtaaattctcatatattttcttcacaagatatatgttgctactctcttgatgctgcagttttgttatagataggtgtatgagtatatatgatttctgaaattagtctatgtatggaaagcacacatgattttatgaagtacttttgcccatgtgctgatttacttaggctaccatttacaaagaaacacattgaaaaggaatttaaaggaaggatagaaagttgcactactaattttttgttttttttttcagaagcagtaaaattaactacagtgttaaatgtatttatttgagcatagtactgaaaacaaaaagcattcaaaaaagagttttttctttattagtaaatagtattttcttaatctcagaggagctgagagttttgttgaatgtattgtacagtatgtaggagcaggagaactttgtaaattggaaagaagtctgtttttataatttatttttatttttaaagcttaaatgtagatatttatacgtatacagggtgcctagaagccaatgttgtttcctgttattacagctaacacagtaaagaataattttgactttaagtatgaaacagtagtaagttatagctgcaaagaatacaatatctatactgtatgtcacatctacctaaatgttgcactatgccctttaaatcatgctggttataaagtagttctaaaaatgtactaaataataatttaatattttctttttaaattatatcgggggtggtcatatacattaatctggtgatttgtatatgtgtttgaaatttttgcattttgtttaaaaaataatatggtaccttggtccctaaaaacagtctgcacttagaagtttatatttactcagtgtttcagaagtggagaacattatcttttatttataaaaatattttgtccttttttaaatgttttgtgtttctctacaggttacaacagttgcttcagttgcctgttttaggtgtttgcacttattttatttcttcttgaaagaatttttatttgcttttgtggtagagattatatgtaattttttttcagtcatataatggtgtgctgtcaacttaaacactgacaggtaaatagaattgtacactgtagtttgaattatttataattgacacactctctccctctccactcctgaagtatgctgctatagaaaatagcagaatcggcttgctgctacgagagaaggaaagagcgaccaccacttgcactgtgtgaaaagataaaaaacaaatgatggcaagttctcaagttaactaaatggaatcaaccattaccaggcaaattcttgcaaataccaaaatactactatgccttataaaacaaaatgaaagcaggttaagattttctgctctgtttgtatgttaatagaaatggaaatactaagtattttaatgcttagctcttgaacagtagacctaaaagggttttaagctatttaaatctacttgctagtttttgcatattttatatatatatatatttatatatatatatagtgagaagtgaagaaaatgtatggtactaagattatgccttattgataaatagataaaccaatttgaatcctcttagcatgtttaagtatgttgattgctttctaattaatgaacttctcacagaaatttcacttagtgaaaccaatgattgtagcaaactcatactggatcatttcagttaccttgaactaatagcacataatggttttttgttgttgttgtttttaatgtagcccttacctggatatacatagtctgcaatcaccaaagtataatatcttgtaaggctatattttttaaagcatattttttcttgagcattaaattatcctaaatggtaatatattgtggataagtctgggcttattggacataatacatatttgggttggtactggttgaatccttcagttaactgctttgttgctttttgcaagattttttatcttaaacatgtcaggcatcttaagtcacctttatactgttttgttcctctgagtttctttcagtatgttatacaaatgccagacataacatgtagcagccatacttgcatggaaactgactacacatacataatactgcattttattgtaaggttttcacattaatacagcaattaccctgactaaattgagttttgtgatatatggaaaacttcattgtaagagaatcttgcatacaatgttgacatattaacatccaaaataaagcatctgtgtacaagctgaaaaaaaaaaa

SEQ ID NO: 455393 - DNA, 2777 bp, Homo sapiens
ataattattgtttataaaatatctaatcagttaaaataactgactttaagagtctaattgtgatatagatagctattttaataattttcatgtcactattaatatttcctttctagtcaaattgtgaatgggaaacagtggtttatgggaagacagaagaccaacttattatgactgaacaagcaagaagatatctgagtacttacacagctaccagtagtacttcaagagctctcatactgtaattgttattaaaattgatgaaatgccccactcccttactgcagtctctactaaattaggttgcagtgaaatttttctcaattagttgtttttaaagttgtaagatagcccttttaatacagcatcttttttctattctatatagtaggcagaaagctagtaagtcacttaaggggtagatagtttcatagtttattttttaagagatgagatttttaaaaattgtttttaaagaacaagatgggaaaataatagaatgttcatggatttctaaaagtaaattctcatatattttcttcacaagatatatgttgctactctcttgatgctgcagttttgttatagataggtgtatgagtatatatgatttctgaaattagtctatgtatggaaagcacacatgattttatgaagtacttttgcccatgtgctgatttacttaggctaccatttacaaagaaacacattgaaaaggaatttaaaggaaggatagaaagttgcactactaattttttgttttttttttcagaagcagtaaaattaactacagtgttaaatgtatttatttgagcatagtactgaaaacaaaaagcattcaaaaaagagttttttctttattagtaaatagtattttcttaatctcagaggagctgagagttttgttgaatgtattgtacagtatgtaggagcaggagaactttgtaaattggaaagaagtctgtttttataatttatttttatttttaaagcttaaatgtagatatttatacgtatacagggtgcctagaagccaatgttgtttcctgttattacagctaacacagtaaagaataattttgactttaagtatgaaacagtagtaagttatagctgcaaagaatacaatatctatactgtatgtcacatctacctaaatgttgcactatgccctttaaatcatgctggttataaagtagttctaaaaatgtactaaataataatttaatattttctttttaaattatatcgggggtggtcatatacattaatctggtgatttgtatatgtgtttgaaatttttgcattttgtttaaaaaataatatggtaccttggtccctaaaaacagtctgcacttagaagtttatatttactcagtgtttcagaagtggagaacattatcttttatttataaaaatattttgtccttttttaaatgttttgtgtttctctacaggttacaacagttgcttcagttgcctgttttaggtgtttgcacttattttatttcttcttgaaagaatttttatttgcttttgtggtagagattatatgtaattttttttcagtcatataatggtgtgctgtcaacttaaacactgacaggtaaatagaattgtacactgtagtttgaattatttataattgacacactctctccctctccactcctgaagtatgctgctatagaaaatagcagaatcggcttgctgctacgagagaaggaaagagcgaccaccacttgcactgtgtgaaaagataaaaaacaaatgatggcaagttctcaagttaactaaatggaatcaaccattaccaggcaaattcttgcaaataccaaaatactactatgccttataaaacaaaatgaaagcaggttaagattttctgctctgtttgtatgttaatagaaatggaaatactaagtattttaatgcttagctcttgaacagtagacctaaaagggttttaagctatttaaatctacttgctagtttttgcatattttatatatatatatatttatatatatatatagtgagaagtgaagaaaatgtatggtactaagattatgccttattgataaatagataaaccaatttgaatcctcttagcatgtttaagtatgttgattgctttctaattaatgaacttctcacagaaatttcacttagtgaaaccaatgattgtagcaaactcatactggatcatttcagttaccttgaactaatagcacataatggttttttgttgttgttgtttttaatgtagcccttacctggatatacatagtctgcaatcaccaaagtataatatcttgtaaggctatattttttaaagcatattttttcttgagcattaaattatcctaaatggtaatatattgtggataagtctgggcttattggacataatacatatttgggttggtactggttgaatccttcagttaactgctttgttgctttttgcaagattttttatcttaaacatgtcaggcatcttaagtcacctttatactgttttgttcctctgagtttctttcagtatgttatacaaatgccagacataacatgtagcagccatacttgcatggaaactgactacacatacataatactgcattttattgtaaggttttcacattaatacagcaattaccctgactaaattgagttttgtgatatatggaaaacttcattgtaagagaatcttgcatacaatgttgacatattaacatccaaaataaagcatctgtgtacaagctgaaaaaaaaaaa

SEQ ID NO: 455394 - DNA, 3039 bp, Homo sapiens
tgcaggagactgcgagccctgcagaactgctagctgcgggggagagggcaggggtcgggcgcctgtggcggagccgggctggggccagggcagggaggctgacaagcggcgggagaagccggcggagggcgggatcgcgcctcctgacatgttgggggtatccctggccgggccgggccggggctaagagcggcgctgcgggccggggtcggggtcgggtcgcggtccgcccccgctgtccctccgtcctgccctgtcgaggacgtgcgttccgcactcggccgcctccagagggagcgagggaagcggctagaggatcggggagaaggagcattcgccggaggctggaggaggctgacccgcgtccccgcccagcctgctcctatgcggtacttgaaggatggcgaagaggtcgcgcaggtgggtggcacccctttcgcccaggcctgtcggcgccgtctcggctcagattctctttcctatcccgctgccccctcccgccataaggccctccctggcgagggcagaggtttttcttcccgcgtccccgcggccgcttggcctcgatgaccggagggcagctgcgacgtgtggagagttggggaccagggtgtttgaggcgcgggacgtaagagatgcccaggtttctcggtgactctccccgtaatgcgcgtccagatttctgacctcatgctgccacttcttcgaggcaggtttcttgccagtgaggatgaggatgatgaccttcagtatgccgatcatgattatgaagtaccacaacaaaaaggactgaagaaactctggaacagagtaaaatggacaagggacgaggatgataaattaaagaagttggttgaacaacatggaactgatgattggactctaattgctagtcatcttcaaaatcgctctgattttcagtgccagcatcgatggcagaaagttttaaatcctgaattgataaagggtccttggactaaagaagaagatcagagggttattgaattagttcagaaatatgggccaaaaagatggtctttaattgcaaaacatttaaaaggaagaataggcaagcagtgtagagaaagatggcataatcatctgaatcctgaggtaaagaaatcttcctggacagaagaggaggacaggatcatctatgaagcacataagcggttgggaaatcgttgggcagaaattgccaaactacttccaggaaggactgataattctatcaaaaatcattggaattctactatgcgaagaaaagtggaacaggagggctatttacaagatggaataaaatcagaacgatcttcatctaaacttcaacacaaaccttgtgcagctatggatcatatgcaaacccagaatcagttttacatacctgttcagatccctgggtatcagtatgtgtcacctgaaggcaattgtatagaacatgttcagcctacttctgcctttattcagcaacccttcattgatgaagatcctgataaggaaaagaaaataaaggaacttgagatgcttcttatgtcagctgagaatgaagttagaagaaagcgaattccatcacagcctggaagtttttctagctggtctggtagtttcctcatggatgataacatgtctaatactctaaatagccttgacgagcacactagtgagttttacagtatggatgaaaatcagcctgtgtctgctcagcagaattcacccacaaagttcctggccgtggaggcaaacgctgtgttatcctctttgcagaccatcccagaatttgcagagactctagaacttattgaatctgatcctgtagcatggagtgacgttaccagttttgatatttctgatgctgctgcttctcctatcaaatccaccccagttaaattaatgagaattcagcacaatgaaggagccatggaatgccaatttaacgtcagtcttgtacttgaagggaaaaaaaacacttgtaatggtggcaacagtgaagctgttcctttaacatccccaaatatagccaagtttagcactccaccagccatcctcagaaagaagagaaaaatgcgagtgggtcattccccaggcagcgaacttagggatggctcattgaacgatggtggtaatatggcgctaaaacatacaccactgaaaacactaccattttctccttcacagtttttcaacacatgtcctggtaatgaacaacttaatatagaaaatccttcatttacatcaacccctatttgtgggcagaaagctctcattacaactcctcttcataaggaaacaactcccaaagatcaaaaggaaaatgtagggtttagaacacctactattagaagatctatactgggtaccacaccaagaactcctactccttttaagaatgcgcttgctgctcaggagaaaaaatatggacctcttaaaattgtgtcccagccacttgctttcttggaagaagatattcgggaagttttaaaagaagaaactggaacagacctattcctcaaagaggaagatgaacctgcttacaaaagctgcaaacaagagaataccgcttctgggaagaaagtcagaaaatcactagtcttagataattgggaaaaagaagaatcaggcactcaactgttgactgaagacatttcagacatgcagtgactgcagcactagtattcctgatattgaagcataccttgaaaacgtctttggcaattacatatgaccaccttacatctgttttcagccactgctttctaagagccatgtagcacattctcttaatccatgtaaaatgatttgagttcctggcgtttaattaacatagaacttttggggaaagttattatatagaagatcacatctataacatagtaatctttaaaataagggaaggaaaaaaacataagcttgattttttgttatgaatatatttcctaatttgtaaataaagcattcttggctcattttttgacattacatcctctctttaaatcttttgcaaaattttgaagcaataaagactaacatttaaaaaaatgt

SEQ ID NO: 455395 - DNA, 254 bp, Homo sapiens
gggcagaaagctctcattacaactcctcttcataaggaaacaactcccaaagatcaaaaggaaaatgtagggtaagtaggtattaaataattgtgttagagaaaatggggagcacagtgttaaagtagattagctttttgtgcatataaatagcaagtatcataattcctattcctacaggacttagaattttttttgttttgttttgttttgtttgtttgagatggaattttgctctcgttgcccaggctgga

SEQ ID NO: 455396 - DNA, 410 bp, Homo sapiens
ctttttggctcagaagttgtaaaacaaagtccttttttttttctgttgggatacgaccagtgtgtaactgcaaatgaaggttggaaaaatttttactgcattaagagtttaccccagagaatttgagagttcattgagtaggaaattttcttctttatgccacagtgactgcagcactagtattcctgatattgaagcataccttgaaaacgtctttggcaattacatatgaccaccttacatctgttttcagccactgctttctaagagccatgtagcacattctcttaatccatgtaaaatgatttgagttcctggcgtttaattaacatagaacttttggggaaagttattatatagaagatcacatctataacatagtaatctttaaaataagggaaggaaaaaaa

SEQ ID NO: 455397 - DNA, 254 bp, Homo sapiens
tcctgaggtaaagaaatcttcctggacagaagaggaggacaggatcatctatgaagcacataagcggttgggaaatcgttgggcagaaattgccaaactacttccaggaaggtgcttatataaatgtatatatatttttctgtacttaaacatgacctttattaccttactgttaaatacatttgcaagtccccgatgacttattttttaaatttgtaattaaaatgtagactatataacataagcaacctttg

SEQ ID NO: 455398 - DNA, 5496 bp, Homo sapiens
tgcaggagactgcgagccctgcagaactgctagctgcgggggagagggcaggggtcgggcgcctgtggcggagccgggctggggccagggcagggaggctgacaagcggcgggagaagccggcggagggcgggatcgcgcctcctgacatgttgggggtatccctggccgggccgggccggggctaagagcggcgctgcgggccggggtcggggtcgggtcgcggtccgcccccgctgtccctccgtcctgccctgtcgaggacgtgcgttccgcactcggccgcctccagagggagcgagggaagcggctagaggatcggggagaaggagcattcgccggaggctggaggaggctgacccgcgtccccgcccagcctgctcctatgcggtacttgaaggatggcgaagaggtcgcgcaggtgggtggcacccctttcgcccaggcctgtcggcgccgtctcggctcagattctctttcctatcccgctgccccctcccgccataaggccctccctggcgagggcagaggtttttcttcccgcgtccccgcggccgcttggcctcgatgaccggagggcagctgcgacgtgtggagagttggggaccagggtgtttgaggcgcgggacgtaagagatgcccaggtttctcggtgactctccccgtaatgcgcgtccagatttctgacctcatgctgccacttcttcgaggcaggtttcttgccagtgaggatgaggatgatgaccttcagtatgccgatcatgattatgaagtaccacaacaaaaaggactgaagaaactctggaacagagtaaaatggacaagggacgaggatgataaattaaagaagttggttgaacaacatggaactgatgattggactctaattgctagtcatcttcaaaatcgctctgattttcagtgccagcatcgatggcagaaagttttaaatcctgaattgataaagggtccttggactaaagaagaagatcagagggttattgaattagttcagaaatatgggccaaaaagatggtctttaattgcaaaacatttaaaaggaagaataggcaagcagtgtagagaaagatggcataatcatctgaatcctgaggtaaagaaatcttcctggacagaagaggaggacaggatcatctatgaagcacataagcggttgggaaatcgttgggcagaaattgccaaactacttccaggaaggactgataattctatcaaaaatcattggaattctactatgcgaagaaaagtggaacaggagggctatttacaagatggaataaaatcagaacgatcttcatctaaacttcaacacaaaccttgtgcagctatggatcatatgcaaacccagaatcagttttacatacctgttcagatccctgggtatcagtatgtgtcacctgaaggcaattgtatagaacatgttcagcctacttctgcctttattcagcaacccttcattgatgaagatcctgataaggaaaagaaaataaaggaacttgagatgcttcttatgtcagctgagaatgaagttagaagaaagcgaattccatcacagcctggaagtttttctagctggtctggtagtttcctcatggatgataacatgtctaatactctaaatagccttgacgagcacactagtgagttttacagtatggatgaaaatcagcctgtgtctgctcagcagaattcacccacaaagttcctggccgtggaggcaaacgctgtgttatcctctttgcagaccatcccagaatttgcagagactctagaacttattgaatctgatcctgtagcatggagtgacgttaccagttttgatatttctgatgctgctgcttctcctatcaaatccaccccagttaaattaatgagaattcagcacaatgaaggagccatggaatgccaatttaacgtcagtcttgtacttgaagggaaaaaaaacacttgtaatggtggcaacagtgaagctgttcctttaacatccccaaatatagccaagtttagcactccaccagccatcctcagaaagaagagaaaaatgcgagtgggtcattccccaggcagcgaacttagggatggctcattgaacgatggtggtaatatggcgctaaaacatacaccactgaaaacactaccattttctccttcacagtttttcaacacatgtcctggtaatgaacaacttaatatagaaaatccttcatttacatcaacccctatttgtgggcagaaagctctcattacaactcctcttcataaggaaacaactcccaaagatcaaaaggaaaatgtagggtttagaacacctactattagaagatctatactgggtaccacaccaagaactcctactccttttaagaatgcgcttgctgctcaggagaaaaaatatggacctcttaaaattgtgtcccagccacttgctttcttggaagaagatattcgggaagttttaaaagaagaaactggaacagacctattcctcaaagaggaagatgaacctgcttacaaaagctgcaaacaagagaataccgcttctgggaagaaagtcagaaaatcactagtcttagataattgggaaaaagaagaatcaggcactcaactgttgactgaagacatttcagacatgcagtcagaaaatagatttactacatccttattaatgataccattattggaaatacatgacaataggtgcaacttgattcctgaaaaacaagatataaattcaaccaacaaaacatatacacttactaaaaagaaaccaaaccctaacacttccaaagttgtcaaattggaaaagaatcttcagtcaaattgtgaatgggaaacagtggtttatgggaagacagaagaccaacttattatgactgaacaagcaagaagatatctgagtacttacacagctaccagtagtacttcaagagctctcatactgtaattgttattaaaattgatgaaatgccccactcccttactgcagtctctactaaattaggttgcagtgaaatttttctcaattagttgtttttaaagttgtaagatagcccttttaatacagcatcttttttctattctatatagtaggcagaaagctagtaagtcacttaaggggtagatagtttcatagtttattttttaagagatgagatttttaaaaattgtttttaaagaacaagatgggaaaataatagaatgttcatggatttctaaaagtaaattctcatatattttcttcacaagatatatgttgctactctcttgatgctgcagttttgttatagataggtgtatgagtatatatgatttctgaaattagtctatgtatggaaagcacacatgattttatgaagtacttttgcccatgtgctgatttacttaggctaccatttacaaagaaacacattgaaaaggaatttaaaggaaggatagaaagttgcactactaattttttgttttttttttcagaagcagtaaaattaactacagtgttaaatgtatttatttgagcatagtactgaaaacaaaaagcattcaaaaaagagttttttctttattagtaaatagtattttcttaatctcagaggagctgagagttttgttgaatgtattgtacagtatgtaggagcaggagaactttgtaaattggaaagaagtctgtttttataatttatttttatttttaaagcttaaatgtagatatttatacgtatacagggtgcctagaagccaatgttgtttcctgttattacagctaacacagtaaagaataattttgactttaagtatgaaacagtagtaagttatagctgcaaagaatacaatatctatactgtatgtcacatctacctaaatgttgcactatgccctttaaatcatgctggttataaagtagttctaaaaatgtactaaataataatttaatattttctttttaaattatatcgggggtggtcatatacattaatctggtgatttgtatatgtgtttgaaatttttgcattttgtttaaaaaataatatggtaccttggtccctaaaaacagtctgcacttagaagtttatatttactcagtgtttcagaagtggagaacattatcttttatttataaaaatattttgtccttttttaaatgttttgtgtttctctacaggttacaacagttgcttcagttgcctgttttaggtgtttgcacttattttatttcttcttgaaagaatttttatttgcttttgtggtagagattatatgtaattttttttcagtcatataatggtgtgctgtcaacttaaacactgacaggtaaatagaattgtacactgtagtttgaattatttataattgacacactctctccctctccactcctgaagtatgctgctatagaaaatagcagaatcggcttgctgctacgagagaaggaaagagcgaccaccacttgcactgtgtgaaaagataaaaaacaaatgatggcaagttctcaagttaactaaatggaatcaaccattaccaggcaaattcttgcaaataccaaaatactactatgccttataaaacaaaatgaaagcaggttaagattttctgctctgtttgtatgttaatagaaatggaaatactaagtattttaatgcttagctcttgaacagtagacctaaaagggttttaagctatttaaatctacttgctagtttttgcatattttatatatatatatatttatatatatatatagtgagaagtgaagaaaatgtatggtactaagattatgccttattgataaatagataaaccaatttgaatcctcttagcatgtttaagtatgttgattgctttctaattaatgaacttctcacagaaatttcacttagtgaaaccaatgattgtagcaaactcatactggatcatttcagttaccttgaactaatagcacataatggttttttgttgttgttgtttttaatgtagcccttacctggatatacatagtctgcaatcaccaaagtataatatcttgtaaggctatattttttaaagcatattttttcttgagcattaaattatcctaaatggtaatatattgtggataagtctgggcttattggacataatacatatttgggttggtactggttgaatccttcagttaactgctttgttgctttttgcaagattttttatcttaaacatgtcaggcatcttaagtcacctttatactgttttgttcctctgagtttctttcagtatgttatacaaatgccagacataacatgtagcagccatacttgcatggaaactgactacacatacataatactgcattttattgtaaggttttcacattaatacagcaattaccctgactaaattgagttttgtgatatatggaaaacttcattgtaagagaatcttgcatacaatgttgacatattaacatccaaaataaagcatctgtgtacaagctgaaaaaaaaaaa

SEQ ID NO: 455399 - DNA, 1161 bp, Homo sapiens
tgcaggagactgcgagccctgcagaactgctagctgcgggggagagggcaggggtcgggcgcctgtggcggagccgggctggggccagggcagggaggctgacaagcggcgggagaagccggcggagggcgggatcgcgcctcctgacatgttgggggtatccctggccgggccgggccggggctaagagcggcgctgcgggccggggtcggggtcgggtcgcggtccgcccccgctgtccctccgtcctgccctgtcgaggacgtgcgttccgcactcggccgcctccagagggagcgagggaagcggctagaggatcggggagaaggagcattcgccggaggctggaggaggctgacccgcgtccccgcccagcctgctcctatgcggtacttgaaggatggcgaagaggtcgcgcaggtgggtggcacccctttcgcccaggcctgtcggcgccgtctcggctcagattctctttcctatcccgctgccccctcccgccataaggccctccctggcgagggcagaggtttttcttcccgcgtccccgcggccgcttggcctcgatgaccggagggcagctgcgacgtgtggagagttggggaccagggtgtttgaggcgcgggacgtaagagatgcccaggtttctcggtgactctccccgtaatgcgcgtccagatttctgacctcatgctgccacttcttcgaggcaggtttcttgccaggtaagtcgagcgcttttagggagtccgctacgcagagaaaactgactgtgtcctgccgggaggacttgaaaatggtgttcgggcgactcttttctgaatgacggtacagtcaaaataggaactccgcggtgaacctgggcggccacccctctgccaacttggctatcttgaaacgttgtggaaaatcctctggggaatagctgagaggacttttttgatgttttctgtaattcctatacccatatgctcagctttatgtatatatgtatattttaatatcctctcttgggaccatgtcacatagtaacaactagtagtaacaactagtagcttgatcttgaaataaaacaatgtgtttgattcacttaatattttgagtgtctgtgtttggctctgaccgtacctaagtgttccacagaggtaaggcacttttttc

SEQ ID NO: 455400 - DNA, 1944 bp, Homo sapiens
ggaggccgagctcggctgggcttggcgaggctgcagcgcggccaccggcgggagtgcagcggccactgtacccagagattcaaaaccccaaacccgggacttgggggcgctgagccgggccgggaagcagagcctggtcgtgaggaacagccgcccgttgctgtctgcccctttgcggacagcgtctccctcgactccgcttaggaagtggtgggggcggcgtggcccccgtcgggaggcgttcgaacgcccgctaggagagagaaaggattcccctgtgcttggagcccgcactcgggcgcggagggagcggcggcaggctctcgctttcggcaccatgggctgcacgctgagcgccgaggacaaggcggcggtggagcggagtaagatgatcgaccgcaacctccgtgaggacggcgagaaggcggcgcgcgaggtcaagctgctgctgctcggtgctggtgaatctggtaaaagtacaattgtgaagcagatgaaaattatccatgaagctggttattcagaagaggagtgtaaacaatacaaagcagtggtctacagtaacaccatccagtcaattattgctatcattagggctatggggaggttgaagatagactttggtgactcagcccgggcggatgatgcacgccaactctttgtgctagctggagctgctgaagaaggctttatgactgcagaacttgctggagttataaagagattgtggaaagatagtggtgtacaagcctgtttcaacagatcccgagagtaccagcttaatgattctgcagcatactatttgaatgacttggacagaatagctcaaccaaattacatcccgactcaacaagatgttctcagaactagagtgaaaactacaggaattgttgaaacccattttactttcaaagatcttcattttaaaatgtttgatgtgggaggtcagagatctgagcggaagaagtggattcattgcttcgaaggagtgacggcgatcatcttctgtgtagcactgagtgactacgacctggttctagctgaagatgaagaaatgaaccgaatgcatgaaagcatgaaattgtttgacagcatatgtaacaacaagtggtttacagatacatccattatactttttctaaacaagaaggatctctttgaagaaaaaatcaaaaagagccctctcactatatgctatccagaatatgcaggatcaaacacatatgaagaggcagctgcatatattcaatgtcagtttgaagacctcaataaaagaaaggacacaaaggaaatatacacccacttcacatgtgccacagatactaagaatgtgcagtttgtttttgatgctgtaacagatgtcatcataaaaaataatctaaaagattgtggtctcttttaagttttgcagttcatggtaaaatgcattttcaaaccaaatgagtacttatatatggatctctgtagactagagtcttgcagcaacacagaatgtaatataaggcaaatgcatctgggacttgaccaaagttgttctgttttgtttttttaactgaaagtaacagaaggacctttcttaaatgtgacagatggtcctgcagtgtgaaactgaaggacagtgttaaagctgggctctagtatattgatgatttctgcataagtgtaaatatgcaaatgtatgtatacatgtatttatgactttagttttcgacattatttttaggttttaagagtggcaacttaggattttagggtgatggctttggaaataacataaatataccttgtactgaatgacagactattactacgtttgccagttttaaacagctttatttatgttcatgtcctgtaaatttttaagtacagtaattaatattaggaaacattacagcccttatctagattatatgtatacttgtattaataaaaatgttatttgta

SEQ ID NO: 455401 - DNA, 474 bp, Homo sapiens
ggaggccgagctcggctgggcttggcgaggctgcagcgcggccaccggcgggagtgcagcggccactgtacccagagattcaaaaccccaaacccgggacttgggggcgctgagccgggccgggaagcagagcctggtcgtgaggaacagccgcccgttgctgtctgcccctttgcggacagcgtctccctcgactccgcttaggaagtggtgggggcggcgtggcccccgtcgggaggcgttcgaacgcccgctaggagagagaaaggattcccctgtgcttggagcccgcactcgggcgcggagggagcggcggcaggctctcgctttcggcaccatgggctgcacgctgagcgccgaggacaaggcggcggtggagcggagtaagatgatcgaccgcaacctccgtgaggacggcgagaaggcggcgcgcgaggtcaagctgctgctgctcggtaagggcggccgggtcgg

SEQ ID NO: 455402 - DNA, 464 bp, Homo sapiens
tctccaaataggacaagactatatacatatagtcttgcatatatatatatatatatatatatatacacacacacacacacacaaataaatatatatgtgtgtgtgtgtgtgtgtaaccataaactatattcatatctgtttcatttggaggattttcttctttgtaatgtaaagaaattcaaagttatcaaagttccttaaatgtgttagtttagattctttatgtgcctttcatgaaagatatgttttcattaattttactggtggacctgtaatatccacattgtgaagctgtgtatgaaattcaactataatatgaataaatttgaatcatgagaattatgggttaaaaagccacaaagaagcacatattggtgaccatcattaatgaaatcctgaactttattctgtgtaattgtgttaataaatcctaataaatttaaatttttaaaattttaaaaaac

SEQ ID NO: 455403 - DNA, 371 bp, Homo sapiens
tagaaaccttttatgttttatatttttaggtgctggtgaatctggtaaaagtacaattgtgaagcagatgaagtaagtagatttaaacaccaaatttgctgtttaagttagtgtaccgttctaccaaaggaagtaaataattcttttttttcccttttgtctcattagaattatccatgaagctggttattcagaagaggagtgtaaacaatacaaagcagtggtctacagtaacaccatccagtcaattattgctatcattagggctatggggaggttgaagatagactttggtgactcagcccgggcggtaagttattaaatttgttggagctgacctgatgggtaaaaagaataacttgtatgctaat

SEQ ID NO: 455404 - DNA, 2107 bp, Homo sapiens
ggaggccgagctcggctgggcttggcgaggctgcagcgcggccaccggcgggagtgcagcggccactgtacccagagattcaaaaccccaaacccgggacttgggggcgctgagccgggccgggaagcagagcctggtcgtgaggaacagccgcccgttgctgtctgcccctttgcggacagcgtctccctcgactccgcttaggaagtggtgggggcggcgtggcccccgtcgggaggcgttcgaacgcccgctaggagagagaaaggattcccctgtgcttggagcccgcactcgggcgcggagggagcggcggcaggctctcgctttcggcaccatgggctgcacgctgagcgccgaggacaaggcggcggtggagcggagtaagatgatcgaccgcaacctccgtgaggacggcgagaaggcggcgcgcgaggtcaagctgctgctgctcggtgctggtgaatctggtaaaagtacaattgtgaagcagatgaaaattatccatgaagctggttattcagaagaggagtgtaaacaatacaaagcagtggtctacagtaacaccatccagtcaattattgctatcattagggctatggggaggttgaagatagactttggtgactcagcccgggcggatgatgcacgccaactctttgtgctagctggagctgctgaagaaggctttatgactgcagaacttgctggagttataaagagattgtggaaagatagtggtgtacaagcctgtttcaacagatcccgagagtaccagcttaatgattctgcagcatactatttgaatgacttggacagaatagctcaaccaaattacatcccgactcaacaagatgttctcagaactagagtgaaaactacaggaattgttgaaacccattttactttcaaagatcttcattttaaaatgtttgatgtgggaggtcagagatctgagcggaagaagtggattcattgcttcgaaggagtgacggcgatcatcttctgtgtagcactgagtgactacgacctggttctagctgaagatgaagaaatgaaccgaatgcatgaaagcatgaaattgtttgacagcatatgtaacaacaagtggtttacagatacatccattatactttttctaaacaagaaggatctctttgaagaaaaaatcaaaaagagccctctcactatatgctatccagaatatgcaggatcaaacacatatgaagaggcagctgcatatattcaatgtcagtttgaagacctcaataaaagaaaggacacaaaggaaatatacacccacttcacatgtgccacagatactaagaatgtgcagtttgtttttgatgctgtaacagatgtcatcataaaaaataatctaaaagattgtggtctcttttaagttttgcagttcatggtaaaatgcattttcaaaccaaatgagtacttatatatggatctctgtagactagagtcttgcagcaacacagaatgtaatataaggcaaatgcatctgggacttgaccaaagttgttctgttttgtttttttaactgaaagtaacagaaggacctttcttaaatgtgacagatggtcctgcagtgtgaaactgaaggacagtgttaaagctgggctctagtatattgatgatttctgcataagtgtaaatatgcaaatgtatgtatacatgtatttatgactttagttttcgacattatttttaggttttaagagtggcaacttaggattttagggtgatggctttggaaataacataaatataccttgtactgaatgacagactattactacgtttgccagttttaaacagctttatttatgttcatgtcctgtaaatttttaagtacagtaattaatattaggaaacattacagcccttatctagattatatgtatacttgtattaataaaaatgttatttgtacaaacattgcacagactattttaataacatgatttgttctttaaattttatgtgttttattgaaatgttcttaagatgaatacacctgcctttggatcaactatttaaacattgtatgcattttgatttttcctactttaagaaaataaaataatttaatttt

SEQ ID NO: 455405 - DNA, 3327 bp, Homo sapiens
ggaggccgagctcggctgggcttggcgaggctgcagcgcggccaccggcgggagtgcagcggccactgtacccagagattcaaaaccccaaacccgggacttgggggcgctgagccgggccgggaagcagagcctggtcgtgaggaacagccgcccgttgctgtctgcccctttgcggacagcgtctccctcgactccgcttaggaagtggtgggggcggcgtggcccccgtcgggaggcgttcgaacgcccgctaggagagagaaaggattcccctgtgcttggagcccgcactcgggcgcggagggagcggcggcaggctctcgctttcggcaccatgggctgcacgctgagcgccgaggacaaggcggcggtggagcggagtaagatgatcgaccgcaacctccgtgaggacggcgagaaggcggcgcgcgaggtcaagctgctgctgctcggtgctggtgaatctggtaaaagtacaattgtgaagcagatgaaaattatccatgaagctggttattcagaagaggagtgtaaacaatacaaagcagtggtctacagtaacaccatccagtcaattattgctatcattagggctatggggaggttgaagatagactttggtgactcagcccgggcggatgatgcacgccaactctttgtgctagctggagctgctgaagaaggctttatgactgcagaacttgctggagttataaagagattgtggaaagatagtggtgtacaagcctgtttcaacagatcccgagagtaccagcttaatgattctgcagcatactatttgaatgacttggacagaatagctcaaccaaattacatcccgactcaacaagatgttctcagaactagagtgaaaactacaggaattgttgaaacccattttactttcaaagatcttcattttaaaatgtttgatgtgggaggtcagagatctgagcggaagaagtggattcattgcttcgaaggagtgacggcgatcatcttctgtgtagcactgagtgactacgacctggttctagctgaagatgaagaaatgaaccgaatgcatgaaagcatgaaattgtttgacagcatatgtaacaacaagtggtttacagatacatccattatactttttctaaacaagaaggatctctttgaagaaaaaatcaaaaagagccctctcactatatgctatccagaatatgcaggatcaaacacatatgaagaggcagctgcatatattcaatgtcagtttgaagacctcaataaaagaaaggacacaaaggaaatatacacccacttcacatgtgccacagatactaagaatgtgcagtttgtttttgatgctgtaacagatgtcatcataaaaaataatctaaaagattgtggtctcttttaagttttgcagttcatggtaaaatgcattttcaaaccaaatgagtacttatatatggatctctgtagactagagtcttgcagcaacacagaatgtaatataaggcaaatgcatctgggacttgaccaaagttgttctgttttgtttttttaactgaaagtaacagaaggacctttcttaaatgtgacagatggtcctgcagtgtgaaactgaaggacagtgttaaagctgggctctagtatattgatgatttctgcataagtgtaaatatgcaaatgtatgtatacatgtatttatgactttagttttcgacattatttttaggttttaagagtggcaacttaggattttagggtgatggctttggaaataacataaatataccttgtactgaatgacagactattactacgtttgccagttttaaacagctttatttatgttcatgtcctgtaaatttttaagtacagtaattaatattaggaaacattacagcccttatctagattatatgtatacttgtattaataaaaatgttatttgtacaaacattgcacagactattttaataacatgatttgttctttaaattttatgtgttttattgaaatgttcttaagatgaatacacctgcctttggatcaactatttaaacattgtatgcattttgatttttcctactttaagaaaataaaataatttaattttacattagattccacgttagatttggtttgaaaaactaaaatttcagatttctgaggatatactgtcttagacttattgtacacacttagtttttattcacttgttttcactctgaattttaatatttggctgatatgaatgcattgcctcaaaggtgatgtcatcttaatttttattcactttaaataactacatttttgtttataactaagtttggagggatcctaagagcatttttgtgggtaaaaaaaaaacctgtggacataatgaattttgagacattgattggtgaggcttttatttcccttgaggagtctcttgtacctagcatacatgatagctccttgttgggaagataacaagaaggatctttgaatactctattgctgatataatgcaagatttaaatttatacatataactaatttcaaatgtaattatcacactatgttaaaattacttttttcccttagataattcaaatttctccacttgcttgagattatatcatttctttttcaattatactattatttctgagaatgaaatggacgattacacttagaaaatgagtaatagtgtttaataagtcagtgattatatgtgtgctcaaataagtgttatgtatcagctagatactgagctttgatagaataattttcttttgattattcatgatgtgtcatctctgaccttgtttcagcaaagtaaacagcactccccaccccaccctcctttttttactcatcttggaaaaggttagtctttcagtacacgttactggtaagtagtttccaagttacgtgttgtcactgggttgaagtatatttgtgtgtgtgtgtgtgtgtgtgtgtgtgtgtgtgtgtgtgtaaccataaactatattcatatctgtttcatttggaggattttcttctttgtaatgtaaagaaattcaaagttatcaaagttccttaaatgtgttagtttagattctttatgtgcctttcatgaaagatatgttttcattaattttactggtggacctgtaatatccacattgtgaagctgtgtatgaaattcaactataatatgaataaatttgaatcatgagaattatgggttaaaaagccacaaagaagcacatattggtgaccatcattaatgaaatcctgaactttattctgtgtaattgtgttaataaatcctaataaatttaaatttttaaaattttaaaaaac

SEQ ID NO: 455406 - DNA, 381 bp, Homo sapiens
ctagcagggaggtggtggtggagtggggagaaagatgttccaagcagaggaagcaatacatggcagggcagggagatgtggctgcctcacaaaggtggggagtagttgaagaacgggctggagtgaggtgggcaaatggtaagcacgtggcacactgttcaactaagataatcacagcattagctgggatttgggggtgaaggagtaggagtgaggggagatgtgtcaatgtccctaagtccacaggggcaggacaaaatagccctatggtctgtctaggacagaggtgttcaatcttttggcttccctgggccacattggaagaagaattgacttgggcaacacataaaatacactaacaatagcagatgaagtaaaaaa

SEQ ID NO: 455407 - DNA, 628 bp, Homo sapiens
agcgggactgggaccggaagtggcgtgtgctcggcctttctgtgttcctggcccgcggccgtcgggtgtgagctgcgccgaccgctctgagggttcgtggcccaccgctccttcgcggtccctgccgccaccgtccacgctcagcgttgtagagaagatggtgggtcggaacagcgccatcgccgccggtgtatgcggggcccttttcattgggtactgcatctacttcgaccgcaaaagacgaagtgaccccaacttcaagaacaggcttcgagaacgaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatgcaattgctgtgtgtggacagccacagcagttactgcaggtcttacagcaaactcttccaccaccagtgttccagatgcttctgactaagctcccaacaattagtcagagaattgtaagtgctcagagcttggctgaagatgatgtggaatgagaaacaaatgtcaacataataaaatctcagtta

SEQ ID NO: 455408 - DNA, 3164 bp, Homo sapiens
agcgggactgggaccggaagtggcgtgtgctcggcctttctgtgttcctggcccgcggccgtcgggtgtgagctgcgccgaccgctctgagggttcgtggcccaccgctccttcgcggtccctgccgccaccgtccacgctcagcgttgtagagaagatggtgggtcggaacagcgccatcgccgccggtgtatgcggggcccttttcattgggtactgcatctacttcgaccgcaaaagacgaagtgaccccaacttcaagaacaggcttcgagaacgaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatgcaattgctgtgtgtggacagccacagcagttactgcaggtcttacagcaaactcttccaccaccagtgttccagatgcttctgactaagctcccaacaattagtcagagaattgtaagtgctcagagcttggctgaagatgatgtggaatgagaaacaaatgtcaacataataaaatctcagttaaaaatattttaaaaattcttggtagttgagcagctctgggggaataagggcaaatatgcttgttatgaactacactgaaatctaccaaagttaatgtttactttgtgtagatccatttgtctattttatttatttttcccagtgaaaagtgtattttgatagagaacttttcattctataaatacactatgagttactaaaatatcatggattttgtttattcctgaaacatagttacatagttaaactgtacatatgacatggcttatgttaaaaatacccagtgctcagttttgaaagataggcaaaaaaaaaaaagtataggagaaactgaagaatgtacacttttttagagggcacattttgctgtaaatctggaaatttgatagacttgactgtgtttgtgaaaactgagcattaaaggttttgattgatcctttctttccatttaatctctgagacgtaaatatgtgaggtgtgctgctgtgctgggttaacagcttccttccctttctgtgtagcagtcttgaaatgttctgtttaaatcagtaggcttaatgtgttctgggtatttatctccttgtattttaaatatatgtagttgcaaatagcaccaggaattagatttctgtacacccctaatctagccttgtgagcttcgctagttaatgtgtgctcactttccctccatttgttacgtgagagaatgcgtctgctgatcactgaagtgtcccttttagcttctgattcattgggttctgttgggcatctttaaatccaccttaacctgaggaatgtatgtgggcaaccaggccctgcatttttttatattctgaattttgcatgcttgcctgacttagtatttctgaattgatgttttttttaatggtataactatcttgattttcactgaaattatatggttctgtcactactctgtaaattaatccgaaacttttaaggtaactgggatgatctgcttgtaaaaatgcttgttgccttttgctttatcttcagtgtacctccttaatcctgcttcaacttgattatcttgtgaaacgatgagagtaagttgcaaccttgtgactgaaaacttgaaaagagtggagcaggtgggacctcttattctcaaatagtgacatattctccgtagtcacagtttcagaactgagtaaggatccttggtacttggtggcatctgttgaactgaggagcatttctcattgtaaagattgcctttgttctgtctaaaagtctggagaaatcccaaagacttttcctatgtactaggcattttattttgattgacttacaaactcttcttaatcattatcaatctcggtttttttgtggtgcagtggaaggagaaataggtctagtttctgcctctgattagccgcacagccttgaacaaatcacatttcatctttgaacttacctctactgttagactaggcgactcacatttgaggacttttctcgggtatcttgagggtttgtgatcctgaacccttaaacagtgcttttttgttacacaggagggcttttttggggggatgaccagtacagacatgccagttagttttactagtgggatcccaaatccaaagcagtgtagtggtgattggtcagtgactaaccaggcagttggggagggtagaaacgccgtttccttgggaactggagtgcagtatgagctgggtgtcacttggctctgaacatactggctttgctgtaatgcttgaaaaggcgttggtatcttcattttacagttcattaacccaagtacgttttcttatttaaatgacaactttggtgctttaaaatgaggtaccactttttaaagctagctgtgtcgagttaaagaaaaaatcagcagttttttctcccagaaatgtaattgccaaacactattcatccccatcttaagttttacaaggtgatgtaatcagcttgttgtagtgatgctggccaaatggtgctcagcaggtgagaacaaaaaaaccccagatttcagtgaactaatacacagcttgagcgtttccatgtgctaatgttgcacacttactaaaaaactttggaaatggaaaataatgtattagtgcaacagttgatgtgcttctttgggcaaagatatagttttgttccacaatttgtacttaaaagcgaaagaacattgaaaacatagacttactggctgtagcaatgctggcctgttaactgataactagaacttaggttcacgtttatgtaaagtgtgtaaaacctagtagagcttgcatagtcggcactcagtaaatgtttggttccttttgccccttggtaagtttattttaccatcctcccacctgccattctgactttattaaatcaacatgtggaccagagtgttaatgagatgttattgcagaagagattgagaaaattggtatatcatgcagataacatacaaaatctttttgtaacgtaaaaaatgcagttttattattgcttgtgcctcaactgtttaagtgaatattaaagggcttggagaaaa

SEQ ID NO: 455409 - DNA, 3003 bp, Homo sapiens
ttggtgaagagttactagctcaagtatttataggaaggaatggctaatgtaaggtcccagagaaggttaatttacctaatcaaggtcacacggtgaatatgagaagggcgtagaccatctgacaaatgcaattgctgtgtgtggacagccacagcagttactgcaggtcttacagcaaactcttccaccaccagtgttccagatgcttctgactaagctcccaacaattagtcagagaattgtaagtgctcagagcttggctgaagatgatgtggaatgagaaacaaatgtcaacataataaaatctcagttaaaaatattttaaaaattcttggtagttgagcagctctgggggaataagggcaaatatgcttgttatgaactacactgaaatctaccaaagttaatgtttactttgtgtagatccatttgtctattttatttatttttcccagtgaaaagtgtattttgatagagaacttttcattctataaatacactatgagttactaaaatatcatggattttgtttattcctgaaacatagttacatagttaaactgtacatatgacatggcttatgttaaaaatacccagtgctcagttttgaaagataggcaaaaaaaaaaaagtataggagaaactgaagaatgtacacttttttagagggcacattttgctgtaaatctggaaatttgatagacttgactgtgtttgtgaaaactgagcattaaaggttttgattgatcctttctttccatttaatctctgagacgtaaatatgtgaggtgtgctgctgtgctgggttaacagcttccttccctttctgtgtagcagtcttgaaatgttctgtttaaatcagtaggcttaatgtgttctgggtatttatctccttgtattttaaatatatgtagttgcaaatagcaccaggaattagatttctgtacacccctaatctagccttgtgagcttcgctagttaatgtgtgctcactttccctccatttgttacgtgagagaatgcgtctgctgatcactgaagtgtcccttttagcttctgattcattgggttctgttgggcatctttaaatccaccttaacctgaggaatgtatgtgggcaaccaggccctgcatttttttatattctgaattttgcatgcttgcctgacttagtatttctgaattgatgttttttttaatggtataactatcttgattttcactgaaattatatggttctgtcactactctgtaaattaatccgaaacttttaaggtaactgggatgatctgcttgtaaaaatgcttgttgccttttgctttatcttcagtgtacctccttaatcctgcttcaacttgattatcttgtgaaacgatgagagtaagttgcaaccttgtgactgaaaacttgaaaagagtggagcaggtgggacctcttattctcaaatagtgacatattctccgtagtcacagtttcagaactgagtaaggatccttggtacttggtggcatctgttgaactgaggagcatttctcattgtaaagattgcctttgttctgtctaaaagtctggagaaatcccaaagacttttcctatgtactaggcattttattttgattgacttacaaactcttcttaatcattatcaatctcggtttttttgtggtgcagtggaaggagaaataggtctagtttctgcctctgattagccgcacagccttgaacaaatcacatttcatctttgaacttacctctactgttagactaggcgactcacatttgaggacttttctcgggtatcttgagggtttgtgatcctgaacccttaaacagtgcttttttgttacacaggagggcttttttggggggatgaccagtacagacatgccagttagttttactagtgggatcccaaatccaaagcagtgtagtggtgattggtcagtgactaaccaggcagctaagaagtcttaggcagcagcccagacatgtatagaggggcagttagagggagaacaggggtgggaaagggagcaaggggcagatagctcagcaaggaaagaatgggctcagaaaaaggagggctggctggaggagtgaggggcagcttaagtttggggagggtagaaacgccgtttccttgggaactggagtgcagtatgagctgggtgtcacttggctctgaacatactggctttgctgtaatgcttgaaaaggcgttggtatcttcattttacagttcattaacccaagtacgttttcttatttaaatgacaactttggtgctttaaaatgaggtaccactttttaaagctagctgtgtcgagttaaagaaaaaatcagcagttttttctcccagaaatgtaattgccaaacactattcatccccatcttaagttttacaaggtgatgtaatcagcttgttgtagtgatgctggccaaatggtgctcagcaggtgagaacaaaaaaaccccagatttcagtgaactaatacacagcttgagcgtttccatgtgctaatgttgcacacttactaaaaaactttggaaatggaaaataatgtattagtgcaacagttgatgtgcttctttgggcaaagatatagttttgttccacaatttgtacttaaaagcgaaagaacattgaaaacatagacttactggctgtagcaatgctggcctgttaactgataactagaacttaggttcacgtttatgtaaagtgtgtaaaacctagtagagcttgcatagtcggcactcagtaaatgtttggttccttttgccccttggtaagtttattttaccatcctcccacctgccattctgactttattaaatcaacatgtggaccagagtgttaatgagatgttattgcagaagagattgagaaaattggtatatcatgcagataacatacaaaatctttttgtaacgtaaaaaatgcagttttattattgcttgtgcctcaactgtttaagtgaatattaaagggcttggagaaaa

SEQ ID NO: 455410 - DNA, 1886 bp, Homo sapiens
  misc_feature (280)..(280): n is a, c, g, or t
  misc_feature (343)..(344): n is a, c, g, or t
  misc_feature (348)..(348): n is a, c, g, or t
ggctagaacgaggctgggttgagcgatctccagctcgctgtgcctgctcaggtggacggcttggccgtggaccctgcccctggcatggtagtgcctgctgtacttccgcactctctctgtgtaccccaagtgcacagtctatggaaaacggatgcctctctccaaccctcctgtatgtacactggcaggatacttccattcttggacctcgctggactgtcctacagcgatggctcccatgttagtctcacatccctgcacctcacggcatcacggtggncgacaccataggactcgagcgatcttcgctgtggacacatgcatcgcatgctcttacttcaannttgnttagcaagtagtcatgcccttgatgcttgcctcgatgcctcacaaaacgctcatgggaacatagagtgcggccaagacgaaccctatggttccctcagtggtaacgtacgggcatttgatactcataggagtgtgacgtggatgacaacgtcttctcatacttattaatcactctcggttctggtgtggatgcagttgtggtgcagtggaaggagaaataggtctagtttctgcctctgattagccgcacagccttgaacaaatcacatttcatctttgaacttacctctactgttagactaggcgactcacatttgaggacttttctcgggtatcttgagggtttgtgatcctgaacccttaaacagtgcttttttgttacacaggagggcttttttggggggatgaccagtacagacatgccagttagttttactagtgggatcccaaatccaaagcagtgtagtggtgattggtcagtgactaaccaggcagctaagaagtcttaggcagcagcccagacatgtatagaggggcagttagagggagaacaggggtgggaaagggagcaaggggcagatagctcagcaaggaaagaatgggctcagaaaaaggagggctggctggaggagtgaggggcagcttaagtttggggagggtagaaacgccgtttccttgggaactggagtgcagtatgagctgggtgtcacttggctctgaacatactggctttgctgtaatgcttgaaaaggcgttggtatcttcattttacagttcattaacccaagtacgttttcttatttaaatgacaactttggtgctttaaaatgaggtaccactttttaaagctagctgtgtcgagttaaagaaaaaatcagcagttttttctcccagaaatgtaattgccaaacactattcatccccatcttaagttttacaaggtgatgtaatcagcttgttgtagtgatgctggccaaatggtgctcagcaggtgagaacaaaaaaaccccagatttcagtgaactaatacacagcttgagcgtttccatgtgctaatgttgcacacttactaaaaaactttggaaatggaaaataatgtattagtgcaacagttgatgtgcttctttgggcaaagatatagttttgttccacaatttgtacttaaaagcgaaagaacattgaaaacatagacttactggctgtagcaatgctggcctgttaactgataactagaacttaggttcacgtttatgtaaagtgtgtaaaacctagtagagcttgcatagtcggcactcagtaaatgtttggttccttttgccccttggtaagtttattttaccatcctcccacctgccattctgactttattaaatcaacatgtggaccagagtgttaatgagatgttattgcagaagagattgagaaaattggtatatcatgcagataacatacaaaatctttttgtaacgtaaaaaatgcagttttattattgcttgtgcctcaactgtttaagtgaatattaaagggcttggagaaaa

SEQ ID NO: 455411 - DNA, 964 bp, Homo sapiens
tcagctgtgaacaaatgggctgaaacaaccgaggtgctgcctgtacgagccacgggctgtcttacacgtgcggagttggggagggtagaaacgccgtttccttgggaactggagtgcagtatgagctgggtgtcacttggctctgaacatactggctttgctgtaatgcttgaaaaggcgttggtatcttcattttacagttcattaacccaagtacgttttcttatttaaatgacaactttggtgctttaaaatgaggtaccactttttaaagctagctgtgtcgagttaaagaaaaaatcagcagttttttctcccagaaatgtaattgccaaacactattcatccccatcttaagttttacaaggtgatgtaatcagcttgttgtagtgatgctggccaaatggtgctcagcaggtgagaacaaaaaaaccccagatttcagtgaactaatacacagcttgagcgtttccatgtgctaatgttgcacacttactaaaaaactttggaaatggaaaataatgtattagtgcaacagttgatgtgcttctttgggcaaagatatagttttgttccacaatttgtacttaaaagcgaaagaacattgaaaacatagacttactggctgtagcaatgctggcctgttaactgataactagaacttaggttcacgtttatgtaaagtgtgtaaaacctagtagagcttgcatagtcggcactcagtaaatgtttggttccttttgccccttggtaagtttattttaccatcctcccacctgccattctgactttattaaatcaacatgtggaccagagtgttaatgagatgttattgcagaagagattgagaaaattggtatatcatgcagataacatacaaaatctttttgtaacgtaaaaaatgcagttttattattgcttgtgcctcaactgtttaagtgaatattaaagggcttggagaaaa

SEQ ID NO: 455412 - DNA, 735 bp, Homo sapiens
agcgggactgggaccggaagtggcgtgtgctcggcctttctgtgttcctggcccgcggccgtcgggtgtgagctgcgccgaccgctctgagggttcgtggcccaccgctccttcgcggtccctgccgccaccgtccacgctcagcgttgtagagaagatggtgggtcggaacagcgccatcgccgccggtgtatgcggggcccttttcattgggtactgcatctacttcgaccgcaaaagacgaagtgaccccaacttcaagaacaggcttcgagaacgaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatgcaattgctgtgtgtggacagccacagcagttactgcaggtcttacagcaaactcttccaccaccagtgttccagatgcttctgactaagctcccaacaattagtcagagaattgtaagtgctcagagcttggctgaagatgatgtggaatgagaaacaaatgtcaacataataaaatctcagttaaaaatattttaaaaattcttggtagttgagcagctctgggggaataagggcaaatgcttgctattgaaacttctaaaactaggggtacagcgctcgattcgatcatg

SEQ ID NO: 455413 - DNA, 602 bp, Homo sapiens
  misc_feature (579)..(579): n is a, c, g, or t
agcgggactgggaccggaagtggcgtgtgctcggcctttctgtgttcctggcccgcggccgtcgggtgtgagctgcgccgaccgctctgagggttcgtggcccaccgctccttcgcggtccctgccgccaccgtccacgctcagcgttgtagagaagatggtgggtcggaacagcgccatcgccgccggtgtatgcggggcccttttcattgggtactgcatctacttcgaccgcaaaagacgaagtgaccccaacttcaagaacaggcttcgagaacgaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatgcaattgctgtgtgtggacagccacagcagttactgcaggtcttacagcaaactcttccaccaccagtgttccagatgcttctgactaagctcccaacaattagtcagagaattgtaagtgctcagagcttggctgnctcccgagtggggtcctcagagg

SEQ ID NO: 455414 - DNA, 3318 bp, Homo sapiens
agcgggactgggaccggaagtggcgtgtgctcggcctttctgtgttcctggcccgcggccgtcgggtgtgagctgcgccgaccgctctgagggttcgtggcccaccgctccttcgcggtccctgccgccaccgtccacgctcagcgttgtagagaagatggtgggtcggaacagcgccatcgccgccggtgtatgcggggcccttttcattgggtactgcatctacttcgaccgcaaaagacgaagtgaccccaacttcaagaacaggcttcgagaacgaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatgcaattgctgtgtgtggacagccacagcagttactgcaggtcttacagcaaactcttccaccaccagtgttccagatgcttctgactaagctcccaacaattagtcagagaattgtaagtgctcagagcttggctgaagatgatgtggaatgagaaacaaatgtcaacataataaaatctcagttaaaaatattttaaaaattcttggtagttgagcagctctgggggaataagggcaaatatgcttgttatgaactacactgaaatctaccaaagttaatgtttactttgtgtagatccatttgtctattttatttatttttcccagtgaaaagtgtattttgatagagaacttttcattctataaatacactatgagttactaaaatatcatggattttgtttattcctgaaacatagttacatagttaaactgtacatatgacatggcttatgttaaaaatacccagtgctcagttttgaaagataggcaaaaaaaaaaaagtataggagaaactgaagaatgtacacttttttagagggcacattttgctgtaaatctggaaatttgatagacttgactgtgtttgtgaaaactgagcattaaaggttttgattgatcctttctttccatttaatctctgagacgtaaatatgtgaggtgtgctgctgtgctgggttaacagcttccttccctttctgtgtagcagtcttgaaatgttctgtttaaatcagtaggcttaatgtgttctgggtatttatctccttgtattttaaatatatgtagttgcaaatagcaccaggaattagatttctgtacacccctaatctagccttgtgagcttcgctagttaatgtgtgctcactttccctccatttgttacgtgagagaatgcgtctgctgatcactgaagtgtcccttttagcttctgattcattgggttctgttgggcatctttaaatccaccttaacctgaggaatgtatgtgggcaaccaggccctgcatttttttatattctgaattttgcatgcttgcctgacttagtatttctgaattgatgttttttttaatggtataactatcttgattttcactgaaattatatggttctgtcactactctgtaaattaatccgaaacttttaaggtaactgggatgatctgcttgtaaaaatgcttgttgccttttgctttatcttcagtgtacctccttaatcctgcttcaacttgattatcttgtgaaacgatgagagtaagttgcaaccttgtgactgaaaacttgaaaagagtggagcaggtgggacctcttattctcaaatagtgacatattctccgtagtcacagtttcagaactgagtaaggatccttggtacttggtggcatctgttgaactgaggagcatttctcattgtaaagattgcctttgttctgtctaaaagtctggagaaatcccaaagacttttcctatgtactaggcattttattttgattgacttacaaactcttcttaatcattatcaatctcggtttttttgtggtgcagtggaaggagaaataggtctagtttctgcctctgattagccgcacagccttgaacaaatcacatttcatctttgaacttacctctactgttagactaggcgactcacatttgaggacttttctcgggtatcttgagggtttgtgatcctgaacccttaaacagtgcttttttgttacacaggagggcttttttggggggatgaccagtacagacatgccagttagttttactagtgggatcccaaatccaaagcagtgtagtggtgattggtcagtgactaaccaggcagctaagaagtcttaggcagcagcccagacatgtatagaggggcagttagagggagaacaggggtgggaaagggagcaaggggcagatagctcagcaaggaaagaatgggctcagaaaaaggagggctggctggaggagtgaggggcagcttaagtttggggagggtagaaacgccgtttccttgggaactggagtgcagtatgagctgggtgtcacttggctctgaacatactggctttgctgtaatgcttgaaaaggcgttggtatcttcattttacagttcattaacccaagtacgttttcttatttaaatgacaactttggtgctttaaaatgaggtaccactttttaaagctagctgtgtcgagttaaagaaaaaatcagcagttttttctcccagaaatgtaattgccaaacactattcatccccatcttaagttttacaaggtgatgtaatcagcttgttgtagtgatgctggccaaatggtgctcagcaggtgagaacaaaaaaaccccagatttcagtgaactaatacacagcttgagcgtttccatgtgctaatgttgcacacttactaaaaaactttggaaatggaaaataatgtattagtgcaacagttgatgtgcttctttgggcaaagatatagttttgttccacaatttgtacttaaaagcgaaagaacattgaaaacatagacttactggctgtagcaatgctggcctgttaactgataactagaacttaggttcacgtttatgtaaagtgtgtaaaacctagtagagcttgcatagtcggcactcagtaaatgtttggttccttttgccccttggtaagtttattttaccatcctcccacctgccattctgactttattaaatcaacatgtggaccagagtgttaatgagatgttattgcagaagagattgagaaaattggtatatcatgcagataacatacaaaatctttttgtaacgtaaaaaatgcagttttattattgcttgtgcctcaactgtttaagtgaatattaaagggcttggagaaaa

SEQ ID NO: 455415 - DNA, 2115 bp, Homo sapiens
agcgggactgggaccggaagtggcgtgtgctcggcctttctgtgttcctggcccgcggccgtcgggtgtgagctgcgccgaccgctctgagggttcgtggcccaccgctccttcgcggtccctgccgccaccgtccacgctcagcgttgtagagaagatggtgggtcggaacagcgccatcgccgccggtgtatgcggggcccttttcattgggtactgcatctacttcgaccgcaaaagacgaagtgaccccaacttcaagaacaggcttcgagaacgaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatgcaattgctgtgtgtggacagccacagcagttactgcaggtcttacagcaaactcttccaccaccagtgttccagatgcttctgactaagctcccaacaattagtcagagaattgtaagtgctcagagcttggctgaagatgatgtggaatgagaaacaaatgtcaacataataaaatctcagttaaaaatattttaaaaattcttggtagttgagcagctctgggggaataagggcaaatatgcttgttatgaactacactgaaatctaccaaagttaatgtttactttgtgtagatccatttgtctattttatttatttttcccagtgaaaagtgtattttgatagagaacttttcattctataaatacactatgagttactaaaatatcatggattttgtttattcctgaaacatagttacatagttaaactgtacatatgacatggcttatgttaaaaatacccagtgctcagttttgaaagataggcaaaaaaaaaaaagtataggagaaactgaagaatgtacacttttttagagggcacattttgctgtaaatctggaaatttgatagacttgactgtgtttgtgaaaactgagcattaaaggttttgattgatcctttctttccatttaatctctgagacgtaaatatgtgaggtgtgctgctgtgctgggttaacagcttccttccctttctgtgtagcagtcttgaaatgttctgtttaaatcagtaggcttaatgtgttctgggtatttatctccttgtattttaaatatatgtagttgcaaatagcaccaggaattagatttctgtacacccctaatctagccttgtgagcttcgctagttaatgtgtgctcactttccctccatttgttacgtgagagaatgcgtctgctgatcactgaagtgtcccttttagcttctgattcattgggttctgttgggcatctttaaatccaccttaacctgaggaatgtatgtgggcaaccaggccctgcatttttttatattctgaattttgcatgcttgcctgacttagtatttctgaattgatgttttttttaatggtataactatcttgattttcactgaaattatatggttctgtcactactctgtaaattaatccgaaacttttaaggtaactgggatgatctgcttgtaaaaatgcttgttgccttttgctttatcttcagtgtacctccttaatcctgcttcaacttgattatcttgtgaaacgatgagagtaagttgcaaccttgtgactgaaaacttgaaaagagtggagcaggtgggacctcttattctcaaatagtgacatattctccgtagtcacagtttcagaactgagtaaggatccttggtacttggtggcatctgttgaactgaggagcatttctcattgtaaagattgcctttgttctgtctaaaagtctggagaaatcccaaagacttttcctatgtactaggcattttattttgattgacttacaaactcttcttaatcattatcaatctcggtttttttgtggtgcagtggaaggagaaataggtctagtttctgcctctgattagccgcacagccttgaacaaatcacatttcatctttgaacttacctctactgttagactaggtgactcgtggaaatgtccacgggtcctgcta

SEQ ID NO: 455416 - DNA, 617 bp, Homo sapiens
agcgggactgggaccggaagtggcgtgtgctcggcctttctgtgttcctggcccgcggccgtcgggtgtgagctgcgccgaccgctctgagggttcgtggcccaccgctccttcgcggtccctgccgccaccgtccacgctcagcgttgtagagaagatggtgggtcggaacagcgccatcgccgccggtgtatgcggggcccttttcattgggtactgcatctacttcgaccgcaaaagacgaagtgaccccaacttcaagaacaggcttcgagaacgaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatgcaattgctgtgtgtggacagccacagcagttactgcaggtcttacagcaaactcttccaccaccagtgttccagatgcttctgactaagctcccaacaattagtcagagaattgtaagtgctcagagcttggctgtagatatagaagagtgcacttttggggtcctctaagtca

SEQ ID NO: 455417 - DNA, 2690 bp, Homo sapiens
ggctagggttagttctggagctggaccaggaggagctgcagctgggccggggcggagcgccgcgtcgcgccagggccgcgaggaggggcgtgttgctgctggcccaccgcgagccgcccccagcccgcgccgaggcgccttcccgccaggccgcctgccttccgcctctttccatttccccggaatctcagcccggcgcgcctggacccctgcccctctctgggtggagaagctcccggccgcttcccggtttcactccttctcagcctgggctcccagccccctctctccttttcctggactggctctcacccccttcggtccccttcctttagctcaggctccctaccccttcctttagcccacagcccagagtcccagctcctcagtcactttcctcagccaaaggtcccagccttccttcttcctttcctttgcactatccctatcctgccccttcctctatccctagggctcagtttcccacatccgtcctcccccttcccaggcccggagttccagaccttttggtctcctttcgtggtcgttcctgggtccttgccccctttccccactttggagttccagattgcaaacccagcctccctccacccccagaaaattgcttccatggaaatgcctctctaaaacatgaacttttcctagagactacgccagtctctcttcccacttgctgaccctttgctacctatgtgcccggttttactctcatttgggtaaggtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctgttaatcattccgtcactgatcatggcatgaagccgcgcaaggcctttccagtcctgggcatcgactacacacacgtgcgcacccccttcgagatctccctctggatccttctggcctgcctcatgaagataggtttccatgtgatccccactatctcaagcatcgtcccggagagctgcctgctgatcgtggtggggctgctggtggggggcctgatcaagggtgtaggcgagacaccccccttcctgcagtccgacgtcttcttcctcttcctgctgccgcccatcatcctggatgcgggctacttcctgccactgcggcagttcacagaaaacctgggcaccatcctgatctttgccgtggtgggcacgctgtggaacgccttcttcctgggcggcctcatgtacgccgtgtgcctggtgggcggtgagcagatcaacaacatcggcctcctggacaacctgctcttcggcagcatcatctcggccgtggaccccgtggcggttctggctgtctttgaggaaattcacatcaatgagctgctgcacatccttgtttttggggagtccttgctcaatgacgccgtcactgtggtcctgtatcacctctttgaggagtttgccaactacgaacacgtgggcatcgtggacatcttcctcggcttcctgagcttcttcgtggtggccctgggcggggtgcttgtgggcgtggtctacggggtcatcgcagccttcacctcccgatttacctcccacatccgggtcatcgagccgctcttcgtcttcctctacagctacatggcctacttgtcagccgagctcttccacctgtcaggcatcatggcgctcatagcctcaggagtggtgatgcgcccctatgtggaggccaacatctcccacaagtcccacaccaccatcaaatacttcctgaagatgtggagcagcgtcagcgagaccctcatcttcatcttcctcggcgtctccacggtggccggctcccaccactggaactggaccttcgtcatcagcaccctgctcttctgcctcatcgcccgcgtgctgggggtgctgggcctgacctggttcatcaacaagttccgtatcgtgaagctgacccccaaggaccagttcatcatcgcctatgggggcctgcgaggggccatcgccttctctctgggctacctcctggacaagaagcacttccccatgtgtgacctgttcctcactgccatcatcactgtcatcttcttcaccgtctttgtgcaggtgctgggcccagggcagggcaggcccttgccttggggaccctcacaggctgttcccgtggaaagagaggaaagcgtgtgattagccatgcgattctagtcccagctccaccaataacttgctgtgtgacctatggcaagccactcccccttgctgggcctcagtgtcttcaagcgtaaagtgagaattgtgatgagtcattgcagagtgactgatcagaatgtaaaggaaccagaaatgctgcccaacttaatttggaactcatagagcattaagagaagtgggtactggccgggcacggtgactcaacgcctgtaatcccagcactttgggaggctgagggggtggatcacctgaggtcaggagtttgagaccagcctgactaacatggtgaaaccccgtctctactaaaaatacaaaattagtgggcatggtg

SEQ ID NO: 455418 - DNA, 382 bp, Homo sapiens
agtgctgggaggtgggagagttctcacacccttgggtcctgggagagagcagagcagagagggcatcctagccttgggggcctggggtgagggagggaggctctgtggcctccctgcctgggtagcagaactggagtgcctgacacctgcctgccccccagggcatgaccattcggcccctggtagacctgttggctgtgaagaaaaagcaagagacgaagcgtccatcctcctctccatgcaagtgctgtttgggcaggagtcaccatgcaagggtgacatcgacaaccacgtaccaagccaccgcagctgctgccactctgctgcctgtacagaagaaactgaatctttttcatattctaataaatcaatgtgagttttt

SEQ ID NO: 455419 - DNA, 4502 bp, Homo sapiens
ggctagggttagttctggagctggaccaggaggagctgcagctgggccggggcggagcgccgcgtcgcgccagggccgcgaggaggggcgtgttgctgctggcccaccgcgagccgcccccagcccgcgccgaggcgccttcccgccaggccgcctgccttccgcctctttccatttccccggaatctcagcccggcgcgcctggacccctgcccctctctgggtggagaagctcccggccgcttcccggtttcactccttctcagcctgggctcccagccccctctctccttttcctggactggctctcacccccttcggtccccttcctttagctcaggctccctaccccttcctttagcccacagcccagagtcccagctcctcagtcactttcctcagccaaaggtcccagccttccttcttcctttcctttgcactatccctatcctgccccttcctctatccctagggctcagtttcccacatccgtcctcccccttcccaggcccggagttccagaccttttggtctcctttcgtggtcgttcctgggtccttgccccctttccccactttggagttccagattgcaaacccagcctccctccacccccagaaaattgcttccatggaaatgcctctctaaaacatgaacttttcctagagactacgccagtctctcttcccacttgctgaccctttgctacctatgtgcccggttttactctcatttgggtaaggtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctgttaatcattccgtcactgatcatggcatgaagccgcgcaaggcctttccagtcctgggcatcgactacacacacgtgcgcacccccttcgagatctccctctggatccttctggcctgcctcatgaagataggtttccatgtgatccccactatctcaagcatcgtcccggagagctgcctgctgatcgtggtggggctgctggtggggggcctgatcaagggtgtaggcgagacaccccccttcctgcagtccgacgtcttcttcctcttcctgctgccgcccatcatcctggatgcgggctacttcctgccactgcggcagttcacagaaaacctgggcaccatcctgatctttgccgtggtgggcacgctgtggaacgccttcttcctgggcggcctcatgtacgccgtgtgcctggtgggcggtgagcagatcaacaacatcggcctcctggacaacctgctcttcggcagcatcatctcggccgtggaccccgtggcggttctggctgtctttgaggaaattcacatcaatgagctgctgcacatccttgtttttggggagtccttgctcaatgacgccgtcactgtggtcctgtatcacctctttgaggagtttgccaactacgaacacgtgggcatcgtggacatcttcctcggcttcctgagcttcttcgtggtggccctgggcggggtgcttgtgggcgtggtctacggggtcatcgcagccttcacctcccgatttacctcccacatccgggtcatcgagccgctcttcgtcttcctctacagctacatggcctacttgtcagccgagctcttccacctgtcaggcatcatggcgctcatagcctcaggagtggtgatgcgcccctatgtggaggccaacatctcccacaagtcccacaccaccatcaaatacttcctgaagatgtggagcagcgtcagcgagaccctcatcttcatcttcctcggcgtctccacggtggccggctcccaccactggaactggaccttcgtcatcagcaccctgctcttctgcctcatcgcccgcgtgctgggggtgctgggcctgacctggttcatcaacaagttccgtatcgtgaagctgacccccaaggaccagttcatcatcgcctatgggggcctgcgaggggccatcgccttctctctgggctacctcctggacaagaagcacttccccatgtgtgacctgttcctcactgccatcatcactgtcatcttcttcaccgtctttgtgcagggcatgaccattcggcccctggtagacctgttggctgtgaagaaaaagcaagagacgaagcgctccatcaacgaagagatccacacacagttcctggaccaccttctgacaggcatcgaagacatctgtggccactacggtcaccaccactggaaggacaagctcaaccggtttaataagaaatatgtgaagaagtgtctgatagctggcgagcgctccaaggagccccagctcattgccttctaccacaagatggagatgaagcaggccatcgagctggtggagagcgggggcatgggcaagatcccctctgccgtctccaccgtctccatgcagaacatccaccccaagtccctgccttccgagcgcatcctgccagcactgtccaaggacaaggaggaggagatccgcaaaatcctgaggaacaacttgcagaagaccaggcagcggctgcggtcctacaacagacacacgctggtggcagacccctacgaggaagcctggaaccagatgctgctccggaggcagaaggcccggcagctggagcagaagatcaacaactacctgacggtgccagcccacaagctggactcacccaccatgtctcgggcccgcatcggctcagacccactggcctatgagccgaaggaggacctgcctgtcatcaccatcgacccggcttccccgcagtcacccgagtctgtggacctggtgaatgaggagctgaagggcaaagtcttagggttgagccgggatcctgcaaaggtggctgaggaggacgaggacgacgatgggggcatcatgatgcggagcaaggagacttcgtccccaggaaccgacgatgtcttcacccccgcgcccagtgacagccccagctcccagaggatacagcgctgcctcagtgacccaggcccacaccctgagcctggggagggagaaccgttcttccccaaggggcagtaacgccagggccagcaggcagcgcctgtcccctcacagactcttccaccagagcaggggctgctgggggctccccttgcccttcctgacccggattggccctgcccctccccctaccgcatggcagctgggcccacagcccccaccccagcacagctcctcccctgccgcctcccgggaagcatcctccccaccagagctgcctccccaatccatttggcagaactgctggggctggtgaggccggccctgcccctccctagatccaggcttctcccggacctggactagggcctcggaggctcctccctctgcctcatcctcctcctcattcagaccaatcttagtttctaaccaaagagtctctggctcagctgtggtcccacccaggaagggagggagctgaggcctcccttgagtaggccctgctttatcaggggacaaaccaggggtaccaggcacatggctgggggagggactgctgacccaccaaggtctcacactcctcctgccagctctgtcaccctggccaccacccaacctgtccttactcagagctgcgggctgagggcatctctgagtgtctctgcctggagcaggggtggtttctacggtgacagtgacgtgactcagagcttttcgaactgtgctcccacggggaccactgggcccctcaggggaagctgctaggggaaggactggccgtggctccagaatgtgctgcctttttaagttttgtttgttcacactcctatatatgattgtttgcacagagggcgctcctgtttttaaaacattttgaaaacccctggctgaacagtgctctgcctctaactccctcctcacactccagaattacccttcctcatctgtgcctgtctgtccaacccctcccccacgtctctctgcctgctgggctcttaactgttgctcgaagactgtgacatcagaagtaactcccactcctaatcaagagtctctccagcctcacagatgctggcctcttggcacctgcctagctcttgggcctgacctccagtcctgctggcctgctcttacttcccccaccctgggtttggcccctggaacctttcccttgggactgggccatgggtcctcggcccatctgtccatcctcctctccatgcaagtgctgtttgggcaggagtcaccatgcaagggtgacatcgacaaccacgtaccaagccaccgcagctgctgccactctgctgcctgtacagaagaaactgaatctttttcatattctaataaatcaatgtgagttttt

SEQ ID NO: 455420 - DNA, 4142 bp, Homo sapiens
ggctagggttagttctggagctggaccaggaggagctgcagctgggccggggcggagcgccgcgtcgcgccagggccgcgaggaggggcgtgttgctgctggcccaccgcgagccgcccccagcccgcgccgaggcgccttcccgccaggccgcctgccttccgcctctttccatttccccggaatctcagcccggcgcgcctggacccctgcccctctctgggtggagaagctcccggccgcttcccggtttcactccttctcagcctgggctcccagccccctctctccttttcctggactggctctcacccccttcggtccccttcctttagctcaggctccctaccccttcctttagcccacagcccagagtcccagctcctcagtcactttcctcagccaaaggtcccagccttccttcttcctttcctttgcactatccctatcctgccccttcctctatccctagggctcagtttcccacatccgtcctcccccttcccaggcccggagttccagaccttttggtctcctttcgtggtcgttcctgggtccttgccccctttccccactttggagttccagattgcaaacccagcctccctccacccccagaaaattgcttccatggaaatgcctctctaaaacatgaacttttcctagagactacgccagtctctcttcccacttgctgaccctttgctacctatgtgcccggttttactctcatttgggtaaggtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctgttaatcattccgtcactgatcatggcatgaagccgcgcaaggcctttccagtcctgggcatcgactacacacacgtgcgcacccccttcgagatctccctctggatccttctggcctgcctcatgaagataggtttccatgtgatccccactatctcaagcatcgtcccggagagctgcctgctgatcgtggtggggctgctggtggggggcctgatcaagggtgtaggcgagacaccccccttcctgcagtccgacgtcttcttcctcttcctgctgccgcccatcatcctggatgcgggctacttcctgccactgcggcagttcacagaaaacctgggcaccatcctgatctttgccgtggtgggcacgctgtggaacgccttcttcctgggcggcctcatgtacgccgtgtgcctggtgggcggtgagcagatcaacaacatcggcctcctggacaacctgctcttcggcagcatcatctcggccgtggaccccgtggcggttctggctgtctttgaggaaattcacatcaatgagctgctgcacatccttgtttttggggagtccttgctcaatgacgccgtcactgtggtcctgtatcacctctttgaggagtttgccaactacgaacacgtgggcatcgtggacatcttcctcggcttcctgagcttcttcgtggtggccctgggcggggtgcttgtgggcgtggtctacggggtcatcgcagccttcacctcccgatttacctcccacatccgggtcatcgagccgctcttcgtcttcctctacagctacatggcctacttgtcagccgagctcttccacctgtcaggcatcatggcgctcatagcctcaggagtggtgatgcgcccctatgtggaggccaacatctcccacaagtcccacaccaccatcaaatacttcctgaagatgtggagcagcgtcagcgagaccctcatcttcatcttcctcggcgtctccacggtggccggctcccaccactggaactggaccttcgtcatcagcaccctgctcttctgcctcatcgcccgcgtgctgggggtgctgggcctgacctggttcatcaacaagttccgtatcgtgaagctgacccccaaggaccagttcatcatcgcctatgggggcctgcgaggggccatcgccttctctctgggctacctcctggacaagaagcacttccccatgtgtgacctgttcctcactgccatcatcactgtcatcttcttcaccgtctttgtgcagggcatgaccattcggcccctggtagacctgttggctgtgaagaaaaagcaagagacgaagcgctccatcaacgaagagatccacacacagttcctggaccaccttctgacaggcatcgaagacatctgtggccactacggtcaccaccactggaaggacaagctcaaccggtttaataagaaatatgtgaagaagtgtctgatagctggcgagcgctccaaggagccccagctcattgccttctaccacaagatggagatgaagcaggccatcgagctggtggagagcgggggcatgggcaagatcccctctgccgtctccaccgtctccatgcagaacatccaccccaagtccctgccttccgagcgcatcctgccagcactgtccaaggacaaggaggaggagatccgcaaaatcctgaggaacaacttgcagaagaccaggcagcggctgcggtcctacaacagacacacgctggtggcagacccctacgaggaagcctggaaccagatgctgctccggaggcagaaggcccggcagctggagcagaagatcaacaactacctgacggtgccagcccacaagctggactcacccaccatgtctcgggcccgcatcggctcagacccactggcctatgagccgaaggaggacctgcctgtcatcaccatcgacccggcttccccgcagtcacccgagtctgtggacctggtgaatgaggagctgaagggcaaagtcttagggttgagccgggatcctgcaaaggtggctgaggaggacgaggacgacgatgggggcatcatgatgcggagcaaggagacttcgtccccaggaaccgacgatgtcttcacccccgcgcccagtgacagccccagctcccagaggatacagcgctgcctcagtgacccaggcccacaccctgagcctggggagggagaaccgttcttccccaaggggcagtaacgccagggccagcaggcagcgcctgtcccctcacagactcttccaccagagcaggggctgctgggggctccccttgcccttcctgacccggattggccctgcccctccccctaccgcatggcagctgggcccacagcccccaccccagcacagctcctcccctgccgcctcccgggaagcatcctccccaccagagctgcctccccaatccatttggcagaactgctggggctggtgaggccggccctgcccctccctagatccaggcttctcccggacctggactagggcctcggaggctcctccctctgcctcatcctcctcctcattcagaccaatcttagtttctaaccaaagagtctctggctcagctgtggtcccacccaggaagggagggagctgaggcctcccttgagtaggccctgctttatcaggggacaaaccaggggtaccaggcacatggctgggggagggactgctgacccaccaaggtctcacactcctcctgccagctctgtcaccctggccaccacccaacctgtccttactcagagctgcgggctgagggcatctctgagtgtctctgcctggagcaggggtggtttctacggtgacagtgacgtgactcagagcttttcgaactgtgctcccacggggaccactgggcccctcaggggaagctgctaggggaaggactggccgtggctccagaatgtgctgcctttttaagttttgtttgttcacactcctatatatgattgtttgcacagagggcgctcctgtttttaaaacattttgaaaacccctggctgaacagtgctctgcctctaactccctcctcacactccagaattacccttcctcatctgtgccccccctggcagatgttccgaactctttcagaaaaggaggccacgagttcctg

SEQ ID NO: 455421 - DNA, 4332 bp, Homo sapiens
ggctagggttagttctggagctggaccaggaggagctgcagctgggccggggcggagcgccgcgtcgcgccagggccgcgaggaggggcgtgttgctgctggcccaccgcgagccgcccccagcccgcgccgaggcgccttcccgccaggccgcctgccttccgcctctttccatttccccggaatctcagcccggcgcgcctggacccctgcccctctctgggtggagaagctcccggccgcttcccggtttcactccttctcagcctgggctcccagccccctctctccttttcctggactggctctcacccccttcggtccccttcctttagctcaggctccctaccccttcctttagcccacagcccagagtcccagctcctcagtcactttcctcagccaaaggtcccagccttccttcttcctttcctttgcactatccctatcctgccccttcctctatccctagggctcagtttcccacatccgtcctcccccttcccaggcccggagttccagaccttttggtctcctttcgtggtcgttcctgggtccttgccccctttccccactttggagttccagattgcaaacccagcctccctccacccccagaaaattgcttccatggaaatgcctctctaaaacatgaacttttcctagagactacgccagtctctcttcccacttgctgaccctttgctacctatgtgcccggttttactctcatttgggtaaggtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctgttaatcattccgtcactgatcatggcatgaagccgcgcaaggcctttccagtcctgggcatcgactacacacacgtgcgcacccccttcgagatctccctctggatccttctggcctgcctcatgaagataggtttccatgtgatccccactatctcaagcatcgtcccggagagctgcctgctgatcgtggtggggctgctggtggggggcctgatcaagggtgtaggcgagacaccccccttcctgcagtccgacgtcttcttcctcttcctgctgccgcccatcatcctggatgcgggctacttcctgccactgcggcagttcacagaaaacctgggcaccatcctgatctttgccgtggtgggcacgctgtggaacgccttcttcctgggcggcctcatgtacgccgtgtgcctggtgggcggtgagcagatcaacaacatcggcctcctggacaacctgctcttcggcagcatcatctcggccgtggaccccgtggcggttctggctgtctttgaggaaattcacatcaatgagctgctgcacatccttgtttttggggagtccttgctcaatgacgccgtcactgtggtcctgtatcacctctttgaggagtttgccaactacgaacacgtgggcatcgtggacatcttcctcggcttcctgagcttcttcgtggtggccctgggcggggtgcttgtgggcgtggtctacggggtcatcgcagccttcacctcccgatttacctcccacatccgggtcatcgagccgctcttcgtcttcctctacagctacatggcctacttgtcagccgagctcttccacctgtcaggcatcatggcgctcatagcctcaggagtggtgatgcgcccctatgtggaggccaacatctcccacaagtcccacaccaccatcaaatacttcctgaagatgtggagcagcgtcagcgagaccctcatcttcatcttcctcggcgtctccacggtggccggctcccaccactggaactggaccttcgtcatcagcaccctgctcttctgcctcatcgcccgcgtgctgggggtgctgggcctgacctggttcatcaacaagttccgtatcgtgaagctgacccccaaggaccagttcatcatcgcctatgggggcctgcgaggggccatcgccttctctctgggctacctcctggacaagaagcacttccccatgtgtgacctgttcctcactgccatcatcactgtcatcttcttcaccgtctttgtgcagggcatgaccattcggcccctggtagacctgttggctgtgaagaaaaagcaagagacgaagcgctccatcaacgaagagatccacacacagttcctggaccaccttctgacaggcatcgaagacatctgtggccactacggtcaccaccactggaaggacaagctcaaccggtttaataagaaatatgtgaagaagtgtctgatagctggcgagcgctccaaggagccccagctcattgccttctaccacaagatggagatgaagcaggccatcgagctggtggagagcgggggcatgggcaagatcccctctgccgtctccaccgtctccatgcagaacatccaccccaagtccctgccttccgagcgcatcctgccagcactgtccaaggacaaggaggaggagatccgcaaaatcctgaggaacaacttgcagaagaccaggcagcggctgcggtcctacaacagacacacgctggtggcagacccctacgaggaagcctggaaccagatgctgctccggaggcagaaggcccggcagctggagcagaagatcaacaactacctgacggtgccagcccacaagctggactcacccaccatgtctcgggcccgcatcggctcagacccactggcctatgagccgaaggaggacctgcctgtcatcaccatcgacccggcttccccgcagtcacccgagtctgtggacctggtgaatgaggagctgaagggcaaagtcttagggttgagccgggatcctgcaaaggtggctgaggaggacgaggacgacgatgggggcatcatgatgcggagcaaggagacttcgtccccaggaaccgacgatgtcttcacccccgcgcccagtgacagccccagctcccagaggatacagcgctgcctcatcctcctcctcattcagaccaatcttagtttctaaccaaagagtctctggctcagctgtggtcccacccaggaagggagggagctgaggcctcccttgagtaggccctgctttatcaggggacaaaccaggggtaccaggcacatggctgggggagggactgctgacccaccaaggtctcacactcctcctgccagctctgtcaccctggccaccacccaacctgtccttactcagagctgcgggctgagggcatctctgagtgtctctgcctggagcaggggtggtttctacggtgacagtgacgtgactcagagcttttcgaactgtgctcccacggggaccactgggcccctcaggggaagctgctaggggaaggactggccgtggctccagaatgtgctgcctttttaagttttgtttgttcacactcctatatatgattgtttgcacagagggcgctcctgtttttaaaacattttgaaaacccctggctgaacagtgctctgcctctaactccctcctcacactccagaattacccttcctcatctgtgcctgtctgtccaacccctcccccacgtctctctgcctgctgggctcttaactgttgctcgaagactgtgacatcagaagtaactcccactcctaatcaagagtctctccagcctcacagatgctggcctcttggcacctgcctagctcttgggcctgacctccagtcctgctggcctgctcttacttcccccaccctgggtttggcccctggaacctttcccttgtgtgtaccacaccctgcctgctgtggaagcccattgtggaggcggtgggggggagaaggcctcccctgaggatcccctgtcccctggggctggtggattgggcagaatcctgggcccccagagacctttgcccacacacactccttccccttgtccctggggcactcccccaggattgtgcaatagtcagagtgtccctttttgcaggggactgggccatgggtcctcggcccatctgtccatcctcctctccatgcaagtgctgtttgggcaggagtcaccatgcaagggtgacatcgacaaccacgtaccaagccaccgcagctgctgccactctgctgcctgtacagaagaaactgaatctttttcatattctaataaatcaatgtgagttttt

SEQ ID NO: 455422 - DNA, 649 bp, Homo sapiens
cacatgaggctcctacacatgaggctcctacacatgaggctcctacacatgagtctctctgcctgctgggctcttaactgttgctcgaagactgtgacatcagaagtaactcccactcctaatcaagagtctctccagcctcacagatgctggcctcttggcacctgcctagctcttgggcctgacctccagtcctgctggcctgctcttacttcccccaccctgggtttggcccctggaacctttcccttgtgtgtaccacaccctgcctgctgtggaagcccattgtggaggcggtgggggggagaaggcctcccctgaggatcccctgtcccctggggctggtggattgggcagaatcctgggcccccagagacctttgcccacacacactccttccccttgtccctggggcactcccccaggattgtgcaatagtcagagtgtccctttttgcaggggactgggccatgggtcctcggcccatctgtccatcctcctctccatgcaagtgctgtttgggcaggagtcaccatgcaagggtgacatcgacaaccacgtaccaagccaccgcagctgctgccactctgctgcctgtacagaagaaactgaatctttttcatattctaataaatcaatgtgagttttt

SEQ ID NO: 455423 - DNA, 2825 bp, Homo sapiens
ggctagggttagttctggagctggaccaggaggagctgcagctgggccggggcggagcgccgcgtcgcgccagggccgcgaggaggggcgtgttgctgctggcccaccgcgagccgcccccagcccgcgccgaggcgccttcccgccaggccgcctgccttccgcctctttccatttccccggaatctcagcccggcgcgcctggacccctgcccctctctgggtggagaagctcccggccgcttcccggtttcactccttctcagcctgggctcccagccccctctctccttttcctggactggctctcacccccttcggtccccttcctttagctcaggctccctaccccttcctttagcccacagcccagagtcccagctcctcagtcactttcctcagccaaaggtcccagccttccttcttcctttcctttgcactatccctatcctgccccttcctctatccctagggctcagtttcccacatccgtcctcccccttcccaggcccggagttccagaccttttggtctcctttcgtggtcgttcctgggtccttgccccctttccccactttggagttccagattgcaaacccagcctccctccacccccagaaaattgcttccatggaaatgcctctctaaaacatgaacttttcctagagactacgccagtctctcttcccacttgctgaccctttgctacctatgtgcccggttttactctcatttgggtaaggtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctgttaatcattccgtcactgatcatggcatgaagccgcgcaaggcctttccagtcctgggcatcgactacacacacgtgcgcacccccttcgagatctccctctggatccttctggcctgcctcatgaagataggtttccatgtgatccccactatctcaagcatcgtcccggagagctgcctgctgatcgtggtggggctgctggtggggggcctgatcaagggtgtaggcgagacaccccccttcctgcagtccgacgtcttcttcctcttcctgctgccgcccatcatcctggatgcgggctacttcctgccactgcggcagttcacagaaaacctgggcaccatcctgatctttgccgtggtgggcacgctgtggaacgccttcttcctgggcggcctcatgtacgccgtgtgcctggtgggcggtgagcagatcaacaacatcggcctcctggacaacctgctcttcggcagcatcatctcggccgtggaccccgtggcggttctggctgtctttgaggaaattcacatcaatgagctgctgcacatccttgtttttggggagtccttgctcaatgacgccgtcactgtggtcctgtatcacctctttgaggagtttgccaactacgaacacgtgggcatcgtggacatcttcctcggcttcctgagcttcttcgtggtggccctgggcggggtgcttgtgggcgtggtctacggggtcatcgcagccttcacctcccgatttacctcccacatccgggtcatcgagccgctcttcgtcttcctctacagctacatggcctacttgtcagccgagctcttccacctgtcaggcatcatggcgctcatagcctcaggagtggtgatgcgcccctatgtggaggccaacatctcccacaagtcccacaccaccatcaaatacttcctgaagatgtggagcagcgtcagcgagaccctcatcttcatcttcctcggcgtctccacggtggccggctcccaccactggaactggaccttcgtcatcagcaccctgctcttctgcctcatcgcccgcgtgctgggggtgctgggcctgacctggttcatcaacaagttccgtatcgtgaagctgacccccaaggaccagttcatcatcgcctatgggggcctgcgaggggccatcgccttctctctgggctacctcctggacaagaagcacttccccatgtgtgacctgttcctcactgccatcatcactgtcatcttcttcaccgtctttgtgcaggtgctgggcccagggcagggcaggcccttgccttggggaccctcacaggctgttcccgtggaaagagaggaaagcgtgtgattagccatgcgattctagtcccagctccaccaataacttgctgtgtgacctatggcaagccactcccccttgctgggcctcagtgtcttcaagcgtaaagtgagaattgtgatgagtcattgcagagtgactgatcagaatgtaaaggaaccagaaatgctgcccaacttaatttggaactcatagagcattaagagaagtgggtactggccgggcacggtgactcaacgcctgtaatcccagcactttgggaggctgagggggtggatcacctgaggtcaggagtttgagaccagcctgactaacatggtgaaaccccgtctctactaaaaatacaaaattagtgggcatggtgatgcatacctgtaattccagctacttgggaggctgaggcaggagaatcacttgaacccaggaggtggaggttgcagtgagctgagattgcgccattgcactccagcctgggtaacaagagtgaaattccatctca

SEQ ID NO: 455424 - DNA, 2445 bp, Homo sapiens
ggctagggttagttctggagctggaccaggaggagctgcagctgggccggggcggagcgccgcgtcgcgccagggccgcgaggaggggcgtgttgctgctggcccaccgcgagccgcccccagcccgcgccgaggcgccttcccgccaggccgcctgccttccgcctctttccatttccccggaatctcagcccggcgcgcctggacccctgcccctctctgggtggagaagctcccggccgcttcccggtttcactccttctcagcctgggctcccagccccctctctccttttcctggactggctctcacccccttcggtccccttcctttagctcaggctccctaccccttcctttagcccacagcccagagtcccagctcctcagtcactttcctcagccaaaggtcccagccttccttcttcctttcctttgcactatccctatcctgccccttcctctatccctagggctcagtttcccacatccgtcctcccccttcccaggcccggagttccagaccttttggtctcctttcgtggtcgttcctgggtccttgccccctttccccactttggagttccagattgcaaacccagcctccctccacccccagaaaattgcttccatggaaatgcctctctaaaacatgaacttttcctagagactacgccagtctctcttcccacttgctgaccctttgctacctatgtgcccggttttactctcatttgggtaaggtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctgttaatcattccgtcactgatcatggcatgaagccgcgcaaggcctttccagtcctgggcatcgactacacacacgtgcgcacccccttcgagatctccctctggatccttctggcctgcctcatgaagataggtttccatgtgatccccactatctcaagcatcgtcccggagagctgcctgctgatcgtggtggggctgctggtggggggcctgatcaagggtgtaggcgagacaccccccttcctgcagtccgacgtcttcttcctcttcctgctgccgcccatcatcctggatgcgggctacttcctgccactgcggcagttcacagaaaacctgggcaccatcctgatctttgccgtggtgggcacgctgtggaacgccttcttcctgggcggcctcatgtacgccgtgtgcctggtgggcggtgagcagatcaacaacatcggcctcctggacaacctgctcttcggcagcatcatctcggccgtggaccccgtggcggttctggctgtctttgaggaaattcacatcaatgagctgctgcacatccttgtttttggggagtccttgctcaatgacgccgtcactgtggtcctgtatcacctctttgaggagtttgccaactacgaacacgtgggcatcgtggacatcttcctcggcttcctgagcttcttcgtggtggccctgggcggggtgcttgtgggcgtggtctacggggtcatcgcagccttcacctcccgatttacctcccacatccgggtcatcgagccgctcttcgtcttcctctacagctacatggcctacttgtcagccgagctcttccacctgtcaggcatcatggcgctcatagcctcaggagtggtgatgcgcccctatgtggaggccaacatctcccacaagtcccacaccaccatcaaatacttcctgaagatgtggagcagcgtcagcgagaccctcatcttcatcttcctcggcgtctccacggtggccggctcccaccactggaactggaccttcgtcatcagcaccctgctcttctgcctcatcgcccgcgtgctgggggtgctgggcctgacctggttcatcaacaagttccgtatcgtgaagctgacccccaaggaccagttcatcatcgcctatgggggcctgcgaggggccatcgccttctctctgggctacctcctggacaagaagcacttccccatgtgtgacctgttcctcactgccatcatcactgtcatcttcttcaccgtctttgtgcagggcatgaccattcggcccctggtagacctgttggctgtgaagaaaaagcaagagacgaagcgctccatcaacgaagagatccacacacagttcctggaccaccttctgacaggcatcgaagacatctgtggccactacggtcaccaccactggaaggacaagtaggtggcaggcctggtgggcaggcaggg

SEQ ID NO: 455425 - DNA, 1378 bp, Homo sapiens
ggctagggttagttctggagctggaccaggaggagctgcagctgggccggggcggagcgccgcgtcgcgccagggccgcgaggaggggcgtgttgctgctggcccaccgcgagccgcccccagcccgcgccgaggcgccttcccgccaggccgcctgccttccgcctctttccatttccccggaatctcagcccggcgcgcctggacccctgcccctctctgggtggagaagctcccggccgcttcccggtttcactccttctcagcctgggctcccagccccctctctccttttcctggactggctctcacccccttcggtccccttcctttagctcaggctccctaccccttcctttagcccacagcccagagtcccagctcctcagtcactttcctcagccaaaggtcccagccttccttcttcctttcctttgcactatccctatcctgccccttcctctatccctagggctcagtttcccacatccgtcctcccccttcccaggcccggagttccagaccttttggtctcctttcgtggtcgttcctgggtccttgccccctttccccactttggagttccagattgcaaacccagcctccctccacccccagaaaattgcttccatggaaatgcctctctaaaacatgaacttttcctagagactacgccagtctctcttcccacttgctgaccctttgctacctatgtgcccggttttactctcatttgggtaaggtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctgttaatcattccgtcactgatcatggcatgaagccgcgcaaggcctttccagtcctgggcatcgactacacacacgtgcgcacccccttcgagatctccctctggatccttctggcctgcctcatgaagatagataattctggggtaaccacagttctgacttggatcatcatcagttgatcttacctgttcttgaacttcatctgaatggaatcataggtactcttgtgtgtctggctgcttttgctcagcctatctgtgagattcctcttcactgtcacatgtaccagaggtttgttcattttattgctgttcggtgttgcctcgtatgaatacaccacagttggctcactctcctgttgatgggcttttggattggttccctttttt

SEQ ID NO: 455426 - DNA, 4710 bp, Homo sapiens
ggctagggttagttctggagctggaccaggaggagctgcagctgggccggggcggagcgccgcgtcgcgccagggccgcgaggaggggcgtgttgctgctggcccaccgcgagccgcccccagcccgcgccgaggcgccttcccgccaggccgcctgccttccgcctctttccatttccccggaatctcagcccggcgcgcctggacccctgcccctctctgggtggagaagctcccggccgcttcccggtttcactccttctcagcctgggctcccagccccctctctccttttcctggactggctctcacccccttcggtccccttcctttagctcaggctccctaccccttcctttagcccacagcccagagtcccagctcctcagtcactttcctcagccaaaggtcccagccttccttcttcctttcctttgcactatccctatcctgccccttcctctatccctagggctcagtttcccacatccgtcctcccccttcccaggcccggagttccagaccttttggtctcctttcgtggtcgttcctgggtccttgccccctttccccactttggagttccagattgcaaacccagcctccctccacccccagaaaattgcttccatggaaatgcctctctaaaacatgaacttttcctagagactacgccagtctctcttcccacttgctgaccctttgctacctatgtgcccggttttactctcatttgggtaaggtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctgttaatcattccgtcactgatcatggcatgaagccgcgcaaggcctttccagtcctgggcatcgactacacacacgtgcgcacccccttcgagatctccctctggatccttctggcctgcctcatgaagataggtttccatgtgatccccactatctcaagcatcgtcccggagagctgcctgctgatcgtggtggggctgctggtggggggcctgatcaagggtgtaggcgagacaccccccttcctgcagtccgacgtcttcttcctcttcctgctgccgcccatcatcctggatgcgggctacttcctgccactgcggcagttcacagaaaacctgggcaccatcctgatctttgccgtggtgggcacgctgtggaacgccttcttcctgggcggcctcatgtacgccgtgtgcctggtgggcggtgagcagatcaacaacatcggcctcctggacaacctgctcttcggcagcatcatctcggccgtggaccccgtggcggttctggctgtctttgaggaaattcacatcaatgagctgctgcacatccttgtttttggggagtccttgctcaatgacgccgtcactgtggtcctgtatcacctctttgaggagtttgccaactacgaacacgtgggcatcgtggacatcttcctcggcttcctgagcttcttcgtggtggccctgggcggggtgcttgtgggcgtggtctacggggtcatcgcagccttcacctcccgatttacctcccacatccgggtcatcgagccgctcttcgtcttcctctacagctacatggcctacttgtcagccgagctcttccacctgtcaggcatcatggcgctcatagcctcaggagtggtgatgcgcccctatgtggaggccaacatctcccacaagtcccacaccaccatcaaatacttcctgaagatgtggagcagcgtcagcgagaccctcatcttcatcttcctcggcgtctccacggtggccggctcccaccactggaactggaccttcgtcatcagcaccctgctcttctgcctcatcgcccgcgtgctgggggtgctgggcctgacctggttcatcaacaagttccgtatcgtgaagctgacccccaaggaccagttcatcatcgcctatgggggcctgcgaggggccatcgccttctctctgggctacctcctggacaagaagcacttccccatgtgtgacctgttcctcactgccatcatcactgtcatcttcttcaccgtctttgtgcagggcatgaccattcggcccctggtagacctgttggctgtgaagaaaaagcaagagacgaagcgctccatcaacgaagagatccacacacagttcctggaccaccttctgacaggcatcgaagacatctgtggccactacggtcaccaccactggaaggacaagctcaaccggtttaataagaaatatgtgaagaagtgtctgatagctggcgagcgctccaaggagccccagctcattgccttctaccacaagatggagatgaagcaggccatcgagctggtggagagcgggggcatgggcaagatcccctctgccgtctccaccgtctccatgcagaacatccaccccaagtccctgccttccgagcgcatcctgccagcactgtccaaggacaaggaggaggagatccgcaaaatcctgaggaacaacttgcagaagaccaggcagcggctgcggtcctacaacagacacacgctggtggcagacccctacgaggaagcctggaaccagatgctgctccggaggcagaaggcccggcagctggagcagaagatcaacaactacctgacggtgccagcccacaagctggactcacccaccatgtctcgggcccgcatcggctcagacccactggcctatgagccgaaggaggacctgcctgtcatcaccatcgacccggcttccccgcagtcacccgagtctgtggacctggtgaatgaggagctgaagggcaaagtcttagggttgagccgggatcctgcaaaggtggctgaggaggacgaggacgacgatgggggcatcatgatgcggagcaaggagacttcgtccccaggaaccgacgatgtcttcacccccgcgcccagtgacagccccagctcccagaggatacagcgctgcctcagtgacccaggcccacaccctgagcctggggagggagaaccgttcttccccaaggggcagtaacgccagggccagcaggcagcgcctgtcccctcacagactcttccaccagagcaggggctgctgggggctccccttgcccttcctgacccggattggccctgcccctccccctaccgcatggcagctgggcccacagcccccaccccagcacagctcctcccctgccgcctcccgggaagcatcctccccaccagagctgcctccccaatccatttggcagaactgctggggctggtgaggccggccctgcccctccctagatccaggcttctcccggacctggactagggcctcggaggctcctccctctgcctcatcctcctcctcattcagaccaatcttagtttctaaccaaagagtctctggctcagctgtggtcccacccaggaagggagggagctgaggcctcccttgagtaggccctgctttatcaggggacaaaccaggggtaccaggcacatggctgggggagggactgctgacccaccaaggtctcacactcctcctgccagctctgtcaccctggccaccacccaacctgtccttactcagagctgcgggctgagggcatctctgagtgtctctgcctggagcaggggtggtttctacggtgacagtgacgtgactcagagcttttcgaactgtgctcccacggggaccactgggcccctcaggggaagctgctaggggaaggactggccgtggctccagaatgtgctgcctttttaagttttgtttgttcacactcctatatatgattgtttgcacagagggcgctcctgtttttaaaacattttgaaaacccctggctgaacagtgctctgcctctaactccctcctcacactccagaattacccttcctcatctgtgcctgtctgtccaacccctcccccacgtctctctgcctgctgggctcttaactgttgctcgaagactgtgacatcagaagtaactcccactcctaatcaagagtctctccagcctcacagatgctggcctcttggcacctgcctagctcttgggcctgacctccagtcctgctggcctgctcttacttcccccaccctgggtttggcccctggaacctttcccttgtgtgtaccacaccctgcctgctgtggaagcccattgtggaggcggtgggggggagaaggcctcccctgaggatcccctgtcccctggggctggtggattgggcagaatcctgggcccccagagacctttgcccacacacactccttccccttgtccctggggcactcccccaggattgtgcaatagtcagagtgtccctttttgcaggggactgggccatgggtcctcggcccatctgtccatcctcctctccatgcaagtgctgtttgggcaggagtcaccatgcaagggtgacatcgacaaccacgtaccaagccaccgcagctgctgccactctgctgcctgtacagaagaaactgaatctttttcatattctaataaatcaatgtgagttttt

SEQ ID NO: 455427 - DNA, 1028 bp, Homo sapiens
ggctagggttagttctggagctggaccaggaggagctgcagctgggccggggcggagcgccgcgtcgcgccagggccgcgaggaggggcgtgttgctgctggcccaccgcgagccgcccccagcccgcgccgaggcgccttcccgccaggccgcctgccttccgcctctttccatttccccggaatctcagcccggcgcgcctggacccctgcccctctctgggtggagaagctcccggccgcttcccggtttcactccttctcagcctgggctcccagccccctctctccttttcctggactggctctcacccccttcggtccccttcctttagctcaggctccctaccccttcctttagcccacagcccagagtcccagctcctcagtcactttcctcagccaaaggtcccagccttccttcttcctttcctttgcactatccctatcctgccccttcctctatccctagggctcagtttcccacatccgtcctcccccttcccaggcccggagttccagaccttttggtctcctttcgtggtcgttcctgggtccttgccccctttccccactttggagttccagattgcaaacccagcctccctccacccccagaaaattgcttccatggaaatgcctctctaaaacatgaacttttcctagagactacgccagtctctcttcccacttgctgaccctttgctacctatgtgcccggttttactctcatttgggtaaggtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctctgagccatttcctgcaagggcctttctgagccctgaact

SEQ ID NO: 455428 - DNA, 4233 bp, Homo sapiens
accatctgacttaggcttttaaagggatccttctggctgctttgttgaaacaataatctgggtggggaaaatggcactgcttggaccagagtgggcaatggaggtggtcagaaatggatggattctggaaatattttgaagattgaattgacactatttgtggaggattgatatgacagaaaggagccaaggatgactcaagtttttggccagagattattcgaaagcccttatgagactgcagatgtggacgtgaaatcgttttgtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctgttaatcattccgtcactgatcatggcatgaagccgcgcaaggcctttccagtcctgggcatcgactacacacacgtgcgcacccccttcgagatctccctctggatccttctggcctgcctcatgaagataggtttccatgtgatccccactatctcaagcatcgtcccggagagctgcctgctgatcgtggtggggctgctggtggggggcctgatcaagggtgtaggcgagacaccccccttcctgcagtccgacgtcttcttcctcttcctgctgccgcccatcatcctggatgcgggctacttcctgccactgcggcagttcacagaaaacctgggcaccatcctgatctttgccgtggtgggcacgctgtggaacgccttcttcctgggcggcctcatgtacgccgtgtgcctggtgggcggtgagcagatcaacaacatcggcctcctggacaacctgctcttcggcagcatcatctcggccgtggaccccgtggcggttctggctgtctttgaggaaattcacatcaatgagctgctgcacatccttgtttttggggagtccttgctcaatgacgccgtcactgtggtcctgtatcacctctttgaggagtttgccaactacgaacacgtgggcatcgtggacatcttcctcggcttcctgagcttcttcgtggtggccctgggcggggtgcttgtgggcgtggtctacggggtcatcgcagccttcacctcccgatttacctcccacatccgggtcatcgagccgctcttcgtcttcctctacagctacatggcctacttgtcagccgagctcttccacctgtcaggcatcatggcgctcatagcctcaggagtggtgatgcgcccctatgtggaggccaacatctcccacaagtcccacaccaccatcaaatacttcctgaagatgtggagcagcgtcagcgagaccctcatcttcatcttcctcggcgtctccacggtggccggctcccaccactggaactggaccttcgtcatcagcaccctgctcttctgcctcatcgcccgcgtgctgggggtgctgggcctgacctggttcatcaacaagttccgtatcgtgaagctgacccccaaggaccagttcatcatcgcctatgggggcctgcgaggggccatcgccttctctctgggctacctcctggacaagaagcacttccccatgtgtgacctgttcctcactgccatcatcactgtcatcttcttcaccgtctttgtgcagggcatgaccattcggcccctggtagacctgttggctgtgaagaaaaagcaagagacgaagcgctccatcaacgaagagatccacacacagttcctggaccaccttctgacaggcatcgaagacatctgtggccactacggtcaccaccactggaaggacaagctcaaccggtttaataagaaatatgtgaagaagtgtctgatagctggcgagcgctccaaggagccccagctcattgccttctaccacaagatggagatgaagcaggccatcgagctggtggagagcgggggcatgggcaagatcccctctgccgtctccaccgtctccatgcagaacatccaccccaagtccctgccttccgagcgcatcctgccagcactgtccaaggacaaggaggaggagatccgcaaaatcctgaggaacaacttgcagaagaccaggcagcggctgcggtcctacaacagacacacgctggtggcagacccctacgaggaagcctggaaccagatgctgctccggaggcagaaggcccggcagctggagcagaagatcaacaactacctgacggtgccagcccacaagctggactcacccaccatgtctcgggcccgcatcggctcagacccactggcctatgagccgaaggaggacctgcctgtcatcaccatcgacccggcttccccgcagtcacccgagtctgtggacctggtgaatgaggagctgaagggcaaagtcttagggttgagccgggatcctgcaaaggtggctgaggaggacgaggacgacgatgggggcatcatgatgcggagcaaggagacttcgtccccaggaaccgacgatgtcttcacccccgcgcccagtgacagccccagctcccagaggatacagcgctgcctcagtgacccaggcccacaccctgagcctggggagggagaaccgttcttccccaaggggcagtaacgccagggccagcaggcagcgcctgtcccctcacagactcttccaccagagcaggggctgctgggggctccccttgcccttcctgacccggattggccctgcccctccccctaccgcatggcagctgggcccacagcccccaccccagcacagctcctcccctgccgcctcccgggaagcatcctccccaccagagctgcctccccaatccatttggcagaactgctggggctggtgaggccggccctgcccctccctagatccaggcttctcccggacctggactagggcctcggaggctcctccctctgcctcatcctcctcctcattcagaccaatcttagtttctaaccaaagagtctctggctcagctgtggtcccacccaggaagggagggagctgaggcctcccttgagtaggccctgctttatcaggggacaaaccaggggtaccaggcacatggctgggggagggactgctgacccaccaaggtctcacactcctcctgccagctctgtcaccctggccaccacccaacctgtccttactcagagctgcgggctgagggcatctctgagtgtctctgcctggagcaggggtggtttctacggtgacagtgacgtgactcagagcttttcgaactgtgctcccacggggaccactgggcccctcaggggaagctgctaggggaaggactggccgtggctccagaatgtgctgcctttttaagttttgtttgttcacactcctatatatgattgtttgcacagagggcgctcctgtttttaaaacattttgaaaacccctggctgaacagtgctctgcctctaactccctcctcacactccagaattacccttcctcatctgtgcctgtctgtccaacccctcccccacgtctctctgcctgctgggctcttaactgttgctcgaagactgtgacatcagaagtaactcccactcctaatcaagagtctctccagcctcacagatgctggcctcttggcacctgcctagctcttgggcctgacctccagtcctgctggcctgctcttacttcccccaccctgggtttggcccctggaacctttcccttgtgtgtaccacaccctgcctgctgtggaagcccattgtggaggcggtgggggggagaaggcctcccctgaggatcccctgtcccctggggctggtggattgggcagaatcctgggcccccagagacctttgcccacacacactccttccccttgtccctggggcactcccccaggattgtgcaatagtcagagtgtccctttttgcaggggactgggccatgggtcctcggcccatctgtccatcctcctctccatgcaagtgctgtttgggcaggagtcaccatgcaagggtgacatcgacaaccacgtaccaagccaccgcagctgctgccactctgctgcctgtacagaagaaactgaatctttttcatattctaataaatcaatgtgagttttt

SEQ ID NO: 455429 - DNA, 2040 bp, Homo sapiens
gtagggaaggcgccccacagcgaggcttgacttggccctgggcccctttcagttcctggaccaccttctgacaggcatcgaagacatctgtggccactacggtcaccaccactggaaggacaagctcaaccggtttaataagaaatatgtgaagaagtgtctgatagctggcgagcgctccaaggagccccagctcattgccttctaccacaagatggagatgaagcaggccatcgagctggtggagagcgggggcatgggcaagatcccctctgccgtctccaccgtctccatgcagaacatccaccccaagtccctgccttccgagcgcatcctgccagcactgtccaaggacaaggaggaggagatccgcaaaatcctgaggaacaacttgcagaagaccaggcagcggctgcggtcctacaacagacacacgctggtggcagacccctacgaggaagcctggaaccagatgctgctccggaggcagaaggcccggcagctggagcagaagatcaacaactacctgacggtgccagcccacaagctggactcacccaccatgtctcgggcccgcatcggctcagacccactggcctatgagccgaaggaggacctgcctgtcatcaccatcgacccggcttccccgcagtcacccgagtctgtggacctggtgaatgaggagctgaagggcaaagtcttagggttgagccgggatcctgcaaaggtggctgaggaggacgaggacgacgatgggggcatcatgatgcggagcaaggagacttcgtccccaggaaccgacgatgtcttcacccccgcgcccagtgacagccccagctcccagaggatacagcgctgcctcatcctcctcctcattcagaccaatcttagtttctaaccaaagagtctctggctcagctgtggtcccacccaggaagggagggagctgaggcctcccttgagtaggccctgctttatcaggggacaaaccaggggtaccaggcacatggctgggggagggactgctgacccaccaaggtctcacactcctcctgccagctctgtcaccctggccaccacccaacctgtccttactcagagctgcgggctgagggcatctctgagtgtctctgcctggagcaggggtggtttctacggtgacagtgacgtgactcagagcttttcgaactgtgctcccacggggaccactgggcccctcaggggaagctgctaggggaaggactggccgtggctccagaatgtgctgcctttttaagttttgtttgttcacactcctatatatgattgtttgcacagagggcgctcctgtttttaaaacattttgaaaacccctggctgaacagtgctctgcctctaactccctcctcacactccagaattacccttcctcatctgtgcctgtctgtccaacccctcccccacgtctctctgcctgctgggctcttaactgttgctcgaagactgtgacatcagaagtaactcccactcctaatcaagagtctctccagcctcacagatgctggcctcttggcacctgcctagctcttgggcctgacctccagtcctgctggcctgctcttacttcccccaccctgggtttggcccctggaacctttcccttgtgtgtaccacaccctgcctgctgtggaagcccattgtggaggcggtgggggggagaaggcctcccctgaggatcccctgtcccctggggctggtggattgggcagaatcctgggcccccagagacctttgcccacacacactccttccccttgtccctggggcactcccccaggattgtgcaatagtcagagtgtccctttttgcaggggactgggccatgggtcctcggcccatctgtccatcctcctctccatgcaagtgctgtttgggcaggagtcaccatgcaagggtgacatcgacaaccacgtaccaagccaccgcagctgctgccactctgctgcctgtacagaagaaactgaatctttttcatattctaataaatcaatgtgagttttt

SEQ ID NO: 455430 - DNA, 3431 bp, Homo sapiens
ggctagggttagttctggagctggaccaggaggagctgcagctgggccggggcggagcgccgcgtcgcgccagggccgcgaggaggggcgtgttgctgctggcccaccgcgagccgcccccagcccgcgccgaggcgccttcccgccaggccgcctgccttccgcctctttccatttccccggaatctcagcccggcgcgcctggacccctgcccctctctgggtggagaagctcccggccgcttcccggtttcactccttctcagcctgggctcccagccccctctctccttttcctggactggctctcacccccttcggtccccttcctttagctcaggctccctaccccttcctttagcccacagcccagagtcccagctcctcagtcactttcctcagccaaaggtcccagccttccttcttcctttcctttgcactatccctatcctgccccttcctctatccctagggctcagtttcccacatccgtcctcccccttcccaggcccggagttccagaccttttggtctcctttcgtggtcgttcctgggtccttgccccctttccccactttggagttccagattgcaaacccagcctccctccacccccagaaaattgcttccatggaaatgcctctctaaaacatgaacttttcctagagactacgccagtctctcttcccacttgctgaccctttgctacctatgtgcccggttttactctcatttgggtaaggtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctgttaatcattccgtcactgatcatggcatgaagccgcgcaaggcctttccagtcctgggcatcgactacacacacgtgcgcacccccttcgagatctccctctggatccttctggcctgcctcatgaagataggtttccatgtgatccccactatctcaagcatcgtcccggagagctgcctgctgatcgtggtggggctgctggtggggggcctgatcaagggtgtaggcgagacaccccccttcctgcagtccgacgtcttcttcctcttcctgctgccgcccatcatcctggatgcgggctacttcctgccactgcggcagttcacagaaaacctgggcaccatcctgatctttgccgtggtgggcacgctgtggaacgccttcttcctgggcggcctcatgtacgccgtgtgcctggtgggcggtgagcagatcaacaacatcggcctcctggacaacctgctcttcggcagcatcatctcggccgtggaccccgtggcggttctggctgtctttgaggaaattcacatcaatgagctgctgcacatccttgtttttggggagtccttgctcaatgacgccgtcactgtggtcctgtatcacctctttgaggagtttgccaactacgaacacgtgggcatcgtggacatcttcctcggcttcctgagcttcttcgtggtggccctgggcggggtgcttgtgggcgtggtctacggggtcatcgcagccttcacctcccgatttacctcccacatccgggtcatcgagccgctcttcgtcttcctctacagctacatggcctacttgtcagccgagctcttccacctgtcaggcatcatggcgctcatagcctcaggagtggtgatgcgcccctatgtggaggccaacatctcccacaagtcccacaccaccatcaaatacttcctgaagatgtggagcagcgtcagcgagaccctcatcttcatcttcctcggcgtctccacggtggccggctcccaccactggaactggaccttcgtcatcagcaccctgctcttctgcctcatcgcccgcgtgctgggggtgctgggcctgacctggttcatcaacaagttccgtatcgtgaagctgacccccaaggaccagttcatcatcgcctatgggggcctgcgaggggccatcgccttctctctgggctacctcctggacaagaagcacttccccatgtgtgacctgttcctcactgccatcatcactgtcatcttcttcaccgtctttgtgcagggcatgaccattcggcccctggtagacctgttggctgtgaagaaaaagcaagagacgaagcgctccatcaacgaagagatccacacacagttcctggaccaccttctgacaggcatcgaagacatctgtggccactacggtcaccaccactggaaggacaagctcaaccggtttaataagaaatatgtgaagaagtgtctgatagctggcgagcgctccaaggagccccagctcattgccttctaccacaagatggagatgaagcaggccatcgagctggtggagagcgggggcatgggcaagatcccctctgccgtctccaccgtctccatgcagaacatccaccccaagtccctgccttccgagcgcatcctgccagcactgtccaaggacaaggaggaggagatccgcaaaatcctgaggaacaacttgcagaagaccaggcagcggctgcggtcctacaacagacacacgctggtggcagacccctacgaggaagcctggaaccagatgctgctccggaggcagaaggcccggcagctggagcagaagatcaacaactacctgacggtgccagcccacaagctggactcacccaccatgtctcgggcccgcatcggctcagacccactggcctatgagccgaaggaggacctgcctgtcatcaccatcgacccggcttccccgcagtcacccgagtctgtggacctggtgaatgaggagctgaagggcaaagtcttagggttgagccgggatcctgcaaaggtggctgaggaggacgaggacgacgatgggggcatcatgatgcggagcaaggagacttcgtccccaggaaccgacgatgtcttcacccccgcgcccagtgacagccccagctcccagaggatacagcgctgcctcagtgacccaggcccacaccctgagcctggggagggagaaccgttcttccccaggattgtgcaatagtcagagtgtccctttttgcaggggactgggccatgggtcctcggcccatctgtccatcctcctctccatgcaagtgctgtttgggcaggagtcaccatgcaagggtgacatcgacaaccacgtaccaagccaccgcagctgctgccactctgctgcctgtacagaagaaactgaatctttttcatattctaataaatcaatgtgagttttt

SEQ ID NO: 455431 - DNA, 1742 bp, Homo sapiens
ggctagggttagttctggagctggaccaggaggagctgcagctgggccggggcggagcgccgcgtcgcgccagggccgcgaggaggggcgtgttgctgctggcccaccgcgagccgcccccagcccgcgccgaggcgccttcccgccaggccgcctgccttccgcctctttccatttccccggaatctcagcccggcgcgcctggacccctgcccctctctgggtggagaagctcccggccgcttcccggtttcactccttctcagcctgggctcccagccccctctctccttttcctggactggctctcacccccttcggtccccttcctttagctcaggctccctaccccttcctttagcccacagcccagagtcccagctcctcagtcactttcctcagccaaaggtcccagccttccttcttcctttcctttgcactatccctatcctgccccttcctctatccctagggctcagtttcccacatccgtcctcccccttcccaggcccggagttccagaccttttggtctcctttcgtggtcgttcctgggtccttgccccctttccccactttggagttccagattgcaaacccagcctccctccacccccagaaaattgcttccatggaaatgcctctctaaaacatgaacttttcctagagactacgccagtctctcttcccacttgctgaccctttgctacctatgtgcccggttttactctcatttgggtaaggtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctgttaatcattccgtcactgatcatggcatgaagccgcgcaaggcctttccagtcctgggcatcgactacacacacgtgcgcacccccttcgagatctccctctggatccttctggcctgcctcatgaagataggtttccatgtgatccccactatctcaagcatcgtcccggagagctgcctgctgatcgtggtggggctgctggtggggggcctgatcaagggtgtaggcgagacaccccccttcctgcagtccgacgtcttcttcctcttcctgctgccgcccatcatcctggatgcgggctacttcctgccactgcggcagttcacagaaaacctgggcaccatcctgatctttgccgtggtgggcacgctgtggaacgccttcttcctgggcggcctcatgtacgccgtgtgcctggtgggcggtgagcagatcaacaacatcggcctcctggacaacctgctcttcggcagcatcatctcggccgtggaccccgtggcggttctggctgtctttgaggaaattcacatcaatgagctgctgcacatccttgtttttggggagtccttgctcaatgacgccgtcactgtggtcctgtatcacctctttgaggagtttgccaactacgaacacgtgggcatcgtggacatcttcctcggcttcctgagcttcttcgtggtggcggggctggtggcctgcttcttgttgatgttcagcatcttctcttcccccaagaccccccgcttaaact

SEQ ID NO: 455432 - DNA, 164 bp, Homo sapiens
gcactgcccccacccctccatgagcagagccttccggggcccgcactgccctgacgctgtccctcccacagctgcggtcctacaacagacacacgctggtggcagacccctacgaggaagcctggaaccagatgctgctccggaggcagaaggcccggcagctg

SEQ ID NO: 455433 - DNA, 3238 bp, Homo sapiens
gaatctgcttccggatcagagggtataggccgcgagatggggaagatggcagcggccgtgggctctgtggcgactctggcgactgagcccggggaggacgcctttcggaaacttttccgcttctaccgtcagagccggcccgggaccgcagacctggaaggggtcatcgacttctcggcggcccacgcagcccgtggcaagggtcctggtgcccaaaaggtgatcaaatctcagctaaatgtgtcttctgtcagtgagcagaatgcatatagagcaggtcttcagcccgtcagcaagtggcaagcctatggactcaaaggctatcctgggtttatttttatcccaaaccccttcctcccaggttaccagtggcactgggtgaaacagtgccttaagttatattcccagaaacctaatgtatgtaacctggacaaacacatgtctaaagaagagacccaagatctgtgggaacagagcaaagagttcctgaggtataaagaagcgactaaacggagaccccgaagtttactggagaaactgcgttgggtgaccgtaggctaccattataactgggacagtaagaaatactcagcagatcattacacacctttcccttctgacctgggtttcctctcagagcaagtagccgctgcctgtggatttgaggatttccgagctgaagcagggatcctgaattactaccgcctggactccacactgggaatccacgtagacagatctgagctagatcactccaaacccttgctgtcattcagctttggacagtccgccatctttctcctgggtggtcttcaaagggatgaggcccccacggccatgtttatgcacagtggtgacatcatgataatgtcgggtttcagccgcctcttgaaccacgcagtccctcgtgtccttccaaatccagaaggggaaggcctgcctcactgcctagaggcacctctccctgctgtcctcccgagagattcaatggtagagccttgttctatggaggactggcaggtgtgtgccagctacttgaagaccgctcgtgttaacatgactgtccgacaggtcctggccacagaccagaatttccctctagaacccatcgaggatgaaaaaagagacatcagtacagaaggtttctgccatctggatgaccagaatagcgaagtaaaacgggccaggataaaccctgacagctgagacttggagatcccatcctttttactcaggcacctgcttaccgtaaatgatcatgttattgtgtattgccgtggacttcagcacccagacaagccaaaaacagagacagggaagaactcattgttgatcacactgttgccttggaacccacgcagaagtaaactcagccactttgctcagagaagtgtttgacatggtctgttcctagttacatgttggctgtaatgtatgttgagaagtcagtccaaggaggtatgttcttccacaacagccttctcagcctctgctatttcctttgaggaaggtagaagtgagtttccatgtttgcagagtatttaaatacctcagattttattaatgagaaatacagtacccctccctccactccatctggtaatttatggtaaaattgtggttctgtgaaccagctattagtctcatcttcttaactccctcaggcatcatcaaattctttgatcttctcttccacctctctggctctcatggaagaatcctttacacatgaaaacaatggaactggaaaatcttgtcttttagaaaagaaattaatcacaactatctctcttgcctaaaagataaatataggtaaacccaaggaaaggggaatttagtttctctacatgtcatttcggtctccaaactccctgttggctttttaatgcaattttaattgttggaataaaaaagtcccaagggtgttttgttactgttttctccatgaataaactcacttgattttaaattaaagatctatatctgtctttggggtttagtctatctgggattaaggtttttttttctgtttttctttgctgtattgttcatgctattgaagccctctagctgtttctgccctacaccattctgctgtgccctaagtattctttgtggctgtctcacagaagagagaacatttcttaatattccagtcactgctgttattgtctgagggtaggcagcttggaaaaatgtaggcaacaccaagttttaatctttatacccccaacaatttgactgactatatcatggtccaggttactttacatttctctggacctcggtttcctcatcataaaatgaagatactgtagactaccatcttcctaaagggatattggtatttgaaagagaattaagtgctcctttctacaaacatgatgtgccaaaattgttttattataagggctctttgaaacatcctaacttccttgtgtggaggactggctggaagcccatttggtacctactgtttgcaatgcatgttattaagtttacatgtctcctctgtcctgctctgccccttttttaaattactggcattgaatattgagttcatatggtaatagcagggtttttaaatgaataaaaattatggatttatctcttaaaagaaaaaaaacaaaaaaaaaaacaaaaaaaaaaaaaaaaaaaaaacaaaaacaaaaaaaaaaaaaaaaaaaaaaaacaaagcggggcgcgcgcgcccccaaaacccccccgcggggcgccccccctccagccgaccaccccgcagtttagctagaaacaaagggggcgcgcctccacataagagaggcagggcagccctattaataccaccagaagcgaacgagcgaggccgcgcggactaataaaaccacacacgaggaccgacgagggagaaaaacagcggcccacgagcagcaatatcacctccgattgagaagaaagaaacccaccaacaaccagcgggggggagagggcgagacaccaccatgagagtggagcgacacaaacaaccacactcaacacgagcgaagaaaaaaattagcacccgcccctaccagacggacgaagcaacaacaaaaaaaaaacaccttacacgacgagagaatgcaaaaaaggaggggcgacacacaaacacaccccagcgtgacatcacaagataacgcgcgaagcagaaaagacaaaacaaactacccgcccaccacacaaaaaggatataatatgcaagacaaacaaaaatataaag

SEQ ID NO: 455434 - DNA, 2966 bp, Homo sapiens
gaatctgcttccggatcagagggtataggccgcgagatggggaagatggcagcggccgtgggctctgtggcgactctggcgactgagcccggggaggacgcctttcggaaacttttccgcttctaccgtcagagccggcccgggaccgcagacctggaaggggtcatcgacttctcggcggcccacgcagcccgtggcaagggtcctggtgcccaaaaggtataaagaagcgactaaacggagaccccgaagtttactggagaaactgcgttgggtgaccgtaggctaccattataactgggacagtaagaaatactcagcagatcattacacacctttcccttctgacctgggtttcctctcagagcaagtagccgctgcctgtggatttgaggatttccgagctgaagcagggatcctgaattactaccgcctggactccacactgggaatccacgtagacagatctgagctagatcactccaaacccttgctgtcattcagctttggacagtccgccatctttctcctgggtggtcttcaaagggatgaggcccccacggccatgtttatgcacagtggtgacatcatgataatgtcgggtttcagccgcctcttgaaccacgcagtccctcgtgtccttccaaatccagaaggggaaggcctgcctcactgcctagaggcacctctccctgctgtcctcccgagagattcaatggtagagccttgttctatggaggactggcaggtgtgtgccagctacttgaagaccgctcgtgttaacatgactgtccgacaggtcctggccacagaccagaatttccctctagaacccatcgaggatgaaaaaagagacatcagtacagaaggtttctgccatctggatgaccagaatagcgaagtaaaacgggccaggataaaccctgacagctgagacttggagatcccatcctttttactcaggcacctgcttaccgtaaatgatcatgttattgtgtattgccgtggacttcagcacccagacaagccaaaaacagagacagggaagaactcattgttgatcacactgttgccttggaacccacgcagaagtaaactcagccactttgctcagagaagtgtttgacatggtctgttcctagttacatgttggctgtaatgtatgttgagaagtcagtccaaggaggtatgttcttccacaacagccttctcagcctctgctatttcctttgaggaaggtagaagtgagtttccatgtttgcagagtatttaaatacctcagattttattaatgagaaatacagtacccctccctccactccatctggtaatttatggtaaaattgtggttctgtgaaccagctattagtctcatcttcttaactccctcaggcatcatcaaattctttgatcttctcttccacctctctggctctcatggaagaatcctttacacatgaaaacaatggaactggaaaatcttgtcttttagaaaagaaattaatcacaactatctctcttgcctaaaagataaatataggtaaacccaaggaaaggggaatttagtttctctacatgtcatttcggtctccaaactccctgttggctttttaatgcaattttaattgttggaataaaaaagtcccaagggtgttttgttactgttttctccatgaataaactcacttgattttaaattaaagatctatatctgtctttggggtttagtctatctgggattaaggtttttttttctgtttttctttgctgtattgttcatgctattgaagccctctagctgtttctgccctacaccattctgctgtgccctaagtattctttgtggctgtctcacagaagagagaacatttcttaatattccagtcactgctgttattgtctgagggtaggcagcttggaaaaatgtaggcaacaccaagttttaatctttatacccccaacaatttgactgactatatcatggtccaggttactttacatttctctggacctcggtttcctcatcataaaatgaagatactgtagactaccatcttcctaaagggatattggtatttgaaagagaattaagtgctcctttctacaaacatgatgtgccaaaattgttttattataagggctctttgaaacatcctaacttccttgtgtggaggactggctggaagcccatttggtacctactgtttgcaatgcatgttattaagtttacatgtctcctctgtcctgctctgccccttttttaaattactggcattgaatattgagttcatatggtaatagcagggtttttaaatgaataaaaattatggatttatctcttaaaagaaaaaaaacaaaaaaaaaaacaaaaaaaaaaaaaaaaaaaaaacaaaaacaaaaaaaaaaaaaaaaaaaaaaaacaaagcggggcgcgcgcgcccccaaaacccccccgcggggcgccccccctccagccgaccaccccgcagtttagctagaaacaaagggggcgcgcctccacataagagaggcagggcagccctattaataccaccagaagcgaacgagcgaggccgcgcggactaataaaaccacacacgaggaccgacgagggagaaaaacagcggcccacgagcagcaatatcacctccgattgagaagaaagaaacccaccaacaaccagcgggggggagagggcgagacaccaccatgagagtggagcgacacaaacaaccacactcaacacgagcgaagaaaaaaattagcacccgcccctaccagacggacgaagcaacaacaaaaaaaaaacaccttacacgacgagagaatgcaaaaaaggaggggcgacacacaaacacaccccagcgtgacatcacaagataacgcgcgaagcagaaaagacaaaacaaactacccgcccaccacacaaaaaggatataatatgcaagacaaacaaaaatataaag

SEQ ID NO: 455435 - DNA, 758 bp, Homo sapiens
ctgttccggggagttctgtggattctgaaatttacccattattttcgatatatatagaagtgggaatgaatacttagcaataaaaatatgtgacaagctgtgggcactctaacatcctggaggacattgtctctctccccgggaaccgcagaagtaaactcagccactttgctcagagaagtgtttgacatggtctgttcctagttacatgttggctgtaatgtatgttgagaagtcagtccaaggaggtatgttcttccacaacagccttctcagcctctgctatttcctttgaggaaggtagaagtgagtttccatgtttgcagagtatttaaatacctcagattttattaatgagaaatacagtacccctccctccactccatctggtaatttatggtaaaattgtggttctgtgaaccagctattagtctcatcttcttaactccctcaggcatcatcaaattctttgatcttctcttccacctctctggctctcatggaagaatcctttacacatgaaaacaatggaactggaaaatcttgtcttttagaaaagaaattaatcacaactatctctcttgcctaaaagataaatataggtaaacccaaggaaaggggaatttagtttctctacatgtcatttcggtctccaaactccctgttggctttttaatgcaattttaattgttggaataaaaaagtcccaagggtgttttgttactgttttctccatgaataaactcacttgattttaa

SEQ ID NO: 455436 - DNA, 1005 bp, Homo sapiens
gaatctgcttccggatcagagggtataggccgcgagatggggaagatggcagcggccgtgggctctgtggcgactctggcgactgagcccggggaggacgcctttcggaaacttttccgcttctaccgtcagagccggcccgggaccgcagacctggaaggggtcatcgacttctcggcggcccacgcagcccgtggcaagggtcctggtgcccaaaaggtgatcaaatctcagctaaatgtgtcttctgtcagtgagcagaatgcatatagagcaggtcttcagcccgtcagcaagtggcaagcctatggactcaaaggctatcctgggtttatttttatcccaaaccccttcctcccaggttaccagtggcactgggtgaaacagtgccttaagttatattcccagaaacctaatgtatgtaacctggacaaacacatgtctaaagaagagacccaagatctgtgggaacagagcaaagagttcctgagggagtccccaaaaccacacccaaatttgatgattcgccaggaagactcaggactcagcagatggttgcacttacagatttatcacagtgaaagcatacaaagcaagatcagcaaagggaaaaggcacctggagcaaagtccaggaaaaaccaggtgcatgcctccaaaagtcctctcccaaggaagtcacaccggatatggcaatgggttgtgacaaaatctgtgaaatgtttaccaaagaaactcagtgcctaggtttttactaggagcttgtcatgtaggcagcctctgcctgacacatgccaaaatcacagactcccagaagcaaagcaggtgttgaccataaaccatattgtttgcacagtttaggtgcagtaagccactcttaacacttccagagaattgtgtgaaccttgccaaggaccatctttgtaagcagaccatcagtcaagtctgctatgtctcttctgcacacctgtcctaaataaatcagtgtgtgttcatttctttttat

SEQ ID NO: 455437 - DNA, 1968 bp, Homo sapiens
gaatctgcttccggatcagagggtataggccgcgagatggggaagatggcagcggccgtgggctctgtggcgactctggcgactgagcccggggaggacgcctttcggaaacttttccgcttctaccgtcagagccggcccgggaccgcagacctggaaggggtcatcgacttctcggcggcccacgcagcccgtggcaagggtcctggtgcccaaaaggtgatcaaatctcagctaaatgtgtcttctgtcagtgagcagaatgcatatagagcaggtcttcagcccgtcagcaagtggcaagcctatggactcaaaggctatcctgggtttatttttatcccaaaccccttcctcccaggttaccagtggcactgggtgaaacagtgccttaagttatattcccagaaacctaatgtatgtaacctggacaaacacatgtctaaagaagagacccaagatctgtgggaacagagcaaagagttcctgaggtataaagaagcgactaaacggagaccccgaagtttactggagaaactgcgttgggtgaccgtaggctaccattataactgggacagtaagaaatactcagcagatcattacacacctttcccttctgacctgggtttcctctcagagcaagtagccgctgcctgtggatttgaggatttccgagctgaagcagggatcctgaattactaccgcctggactccacactgggaatccacgtagacagatctgagctagatcactccaaacccttgctgtcattcagctttggacagtccgccatctttctcctgggtggtcttcaaagggatgaggcccccacggccatgtttatgcacagtggtgacatcatgataatgtcgggtttcagccgcctcttgaaccacgcagtccctcgtgtccttccaaatccagaaggggaaggcctgcctcactgcctagaggcacctctccctgctgtcctcccgagagattcaatggtagagccttgttctatggaggactggcaggtgtgtgccagctacttgaagaccgctcgtgttaacatgactgtccgacaggtcctggccacagaccagaatttccctctagaacccatcgaggatgaaaaaagagacatcagtacagaaggtttctgccatctggatgaccagaatagcgaagtaaaacgggccaggataaaccctgacagctgagacttggagatcccatcctttttactcaggcacctgcttaccgtaaatgatcatgttattgtgtattgccgtggacttcagcacccagacaagccaaaaacagagacagggaagaactcattgttgatcacactgttgccttggaacccacgcagaagtaaactcagccactttgctcagagaagtgtttgacatggtctgttcctagttacatgttggctgtaatgtatgttgagaagtcagtccaaggaggtatgttcttccacaacagccttctcagcctctgctatttcctttgaggaaggtagaagtgagtttccatgtttgcagagtatttaaatacctcagattttattaatgagaaatacagtacccctccctccactccatctggtaatttatggtaaaattgtggttctgtgaaccagctattagtctcatcttcttaactccctcaggcatcatcaaattctttgatcttctcttccacctctctggctctcatggaagaatcctttacacatgaaaacaatggaactggaaaatcttgtcttttagaaaagaaattaatcacaactatctctcttgcctaaaagataaatataggtaaacccaaggaaaggggaatttagtttctctacatgtcatttcggtctccaaactccctgttggctttttaatgcaattttaattgttggaataaaaaagtcccaagggtgttttgttactgttttctccatgaataaactcacttgattttaa

SEQ ID NO: 455438 - DNA, 3075 bp, Homo sapiens
gaatctgcttccggatcagagggtataggccgcgagatggggaagatggcagcggccgtgggctctgtggcgactctggcgactgagcccggggaggacgcctttcggaaacttttccgcttctaccgtcagagccggcccgggaccgcagacctggaaggggtcatcgacttctcggcggcccacgcagcccgtggcaagggtcctggtgcccaaaaggtgatcaaatctcagctaaatgtgtcttctgtcagtgagcagaatgcatatagagcaggtcttcagcccgtcagcaagtggcaagcctatggactcaaaggctatcctggtataaagaagcgactaaacggagaccccgaagtttactggagaaactgcgttgggtgaccgtaggctaccattataactgggacagtaagaaatactcagcagatcattacacacctttcccttctgacctgggtttcctctcagagcaagtagccgctgcctgtggatttgaggatttccgagctgaagcagggatcctgaattactaccgcctggactccacactgggaatccacgtagacagatctgagctagatcactccaaacccttgctgtcattcagctttggacagtccgccatctttctcctgggtggtcttcaaagggatgaggcccccacggccatgtttatgcacagtggtgacatcatgataatgtcgggtttcagccgcctcttgaaccacgcagtccctcgtgtccttccaaatccagaaggggaaggcctgcctcactgcctagaggcacctctccctgctgtcctcccgagagattcaatggtagagccttgttctatggaggactggcaggtgtgtgccagctacttgaagaccgctcgtgttaacatgactgtccgacaggtcctggccacagaccagaatttccctctagaacccatcgaggatgaaaaaagagacatcagtacagaaggtttctgccatctggatgaccagaatagcgaagtaaaacgggccaggataaaccctgacagctgagacttggagatcccatcctttttactcaggcacctgcttaccgtaaatgatcatgttattgtgtattgccgtggacttcagcacccagacaagccaaaaacagagacagggaagaactcattgttgatcacactgttgccttggaacccacgcagaagtaaactcagccactttgctcagagaagtgtttgacatggtctgttcctagttacatgttggctgtaatgtatgttgagaagtcagtccaaggaggtatgttcttccacaacagccttctcagcctctgctatttcctttgaggaaggtagaagtgagtttccatgtttgcagagtatttaaatacctcagattttattaatgagaaatacagtacccctccctccactccatctggtaatttatggtaaaattgtggttctgtgaaccagctattagtctcatcttcttaactccctcaggcatcatcaaattctttgatcttctcttccacctctctggctctcatggaagaatcctttacacatgaaaacaatggaactggaaaatcttgtcttttagaaaagaaattaatcacaactatctctcttgcctaaaagataaatataggtaaacccaaggaaaggggaatttagtttctctacatgtcatttcggtctccaaactccctgttggctttttaatgcaattttaattgttggaataaaaaagtcccaagggtgttttgttactgttttctccatgaataaactcacttgattttaaattaaagatctatatctgtctttggggtttagtctatctgggattaaggtttttttttctgtttttctttgctgtattgttcatgctattgaagccctctagctgtttctgccctacaccattctgctgtgccctaagtattctttgtggctgtctcacagaagagagaacatttcttaatattccagtcactgctgttattgtctgagggtaggcagcttggaaaaatgtaggcaacaccaagttttaatctttatacccccaacaatttgactgactatatcatggtccaggttactttacatttctctggacctcggtttcctcatcataaaatgaagatactgtagactaccatcttcctaaagggatattggtatttgaaagagaattaagtgctcctttctacaaacatgatgtgccaaaattgttttattataagggctctttgaaacatcctaacttccttgtgtggaggactggctggaagcccatttggtacctactgtttgcaatgcatgttattaagtttacatgtctcctctgtcctgctctgccccttttttaaattactggcattgaatattgagttcatatggtaatagcagggtttttaaatgaataaaaattatggatttatctcttaaaagaaaaaaaacaaaaaaaaaaacaaaaaaaaaaaaaaaaaaaaaacaaaaacaaaaaaaaaaaaaaaaaaaaaaaacaaagcggggcgcgcgcgcccccaaaacccccccgcggggcgccccccctccagccgaccaccccgcagtttagctagaaacaaagggggcgcgcctccacataagagaggcagggcagccctattaataccaccagaagcgaacgagcgaggccgcgcggactaataaaaccacacacgaggaccgacgagggagaaaaacagcggcccacgagcagcaatatcacctccgattgagaagaaagaaacccaccaacaaccagcgggggggagagggcgagacaccaccatgagagtggagcgacacaaacaaccacactcaacacgagcgaagaaaaaaattagcacccgcccctaccagacggacgaagcaacaacaaaaaaaaaacaccttacacgacgagagaatgcaaaaaaggaggggcgacacacaaacacaccccagcgtgacatcacaagataacgcgcgaagcagaaaagacaaaacaaactacccgcccaccacacaaaaaggatataatatgcaagacaaacaaaaatataaag

SEQ ID NO: 455439 - DNA, 2059 bp, Homo sapiens
ccgcggccgctgccggacttcgccagatcagacccacggggctgccctcccctgcgcactcccctcgctgcccgggcccggagcgcagcgcggccgcacagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggg

SEQ ID NO: 455440 - DNA, 629 bp, Homo sapiens
  misc_feature (14)..(14): n is a, c, g, or t
  misc_feature (36)..(36): n is a, c, g, or t
acaaataccagganaaatctgggaaatgaaaaatgnagagttctaccttacgacaaacaagtcctgtaagtgcaatgcttgtgctcgtgaagtcattatcaggaccaagagaacatatcgtggacctggagatgctgacagtcagcagtatacattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggg

SEQ ID NO: 455441 - DNA, 1274 bp, Homo sapiens
  misc_feature (14)..(14): n is a, c, g, or t
  misc_feature (36)..(36): n is a, c, g, or t
acaaataccagganaaatctgggaaatgaaaaatgnagagttctaccttacgacaaacaagtcctgtaagtgcaatgcttgtgctcgtgaagtcattatcaggaccaagagaacatatcgtggacctggagatgctgacagtcagcagtatacattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggggatctgccatatttgtgttggtttttattttcatatccagcctaaaggtggttgtttattatatagtaataaatcattgctgtacaatatgctggtttctgtagggtatttttaattttgtcagaaattttagattgtgaatattttgtaaaaaacagtaagcaaaattttccagaattcccaaaatgaaccagatatcccctagaaaattatactattgagaaatctatggggaggatatgagaaaataaattccttctaaaccacattggaactgacctgaagaagcaaactcggaaaatataataacatccctgaattcaggacttccacaagatgcagaacaaaatggataaaaggtatttcactggagaagttttaatttctaagtaaaatttaaatcctaacacttcactaatttataactaaaatttctcatcttcgtacttgatgctcacagaggaagaaaatgatgatggtttttattcctggcatccagagtgacagtgaacttaagcaaattaccctcctacccaattctatggaatattttatacgtctccttgtttaaaatgtcactgctttactttgatgtatcatatttttaaataaaaataaatattcctttagaagatcactctaaaa

SEQ ID NO: 455442 - DNA, 584 bp, Homo sapiens
ccgcggccgctgccggacttcgccagatcagacccacggggctgccctcccctgcgcactcccctcgctgcccgggcccggagcgcagcgcggccgcacaggtatttttgctgtgctgtgcaaggaactctgctagctcaagcgtagcaggatggagtaacgtgaaatgcaattctacagcagtttttacgtctttgctgcctcgttcgttggctaccgagaaggttcaggagggggaggggagatgagaaagcagattggaagttgagtatggtggagcctcagcctctcccaccctcctttcctcgcttgtgctcactgctaaagttttgttactttcccccccgagagagcgtcccccaccgagagagcgtcgacgctctctcttacctctcacctctggggaataatcaagtcccgtaaacacttcctaggaagtgtctcacagtcttcccactcctctctatgctcctgccactatcacagttcaacttgcatcatcttttccttccaaagacccctaattgtgtcccttccttcaggattctgcaatttctagccctttccaccccacagagagagct

SEQ ID NO: 455443 - DNA, 2100 bp, Homo sapiens
ccgcggccgctgccggacttcgccagatcagacccacggggctgccctcccctgcgcactcccctcgctgcccgggcccggagcgcagcgcggccgcacaggtatttttgctgtgctgtgcaaggaactctgctagctcaagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggg

SEQ ID NO: 455444 - DNA, 1998 bp, Homo sapiens
  misc_feature (17)..(17): n is a, c, g, or t
  misc_feature (20)..(20): n is a, c, g, or t
ctgtgcaagggaactcnttnagctcaagcctgctttgtagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggg

SEQ ID NO: 455445 - DNA, 2082 bp, Homo sapiens
gagagagagagagagagagagagagagagagagagagagagagagagagagagagagagagaatagaatgttaaaccacccatctcatcatatatctaggactttagcacaaggattgttgccataagaatgaagcttttagagtgatttcttagggaatggacacaccaattaactgtctcctggccccacctttgatgttttcttcacagcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggg

SEQ ID NO: 455446 - DNA, 2005 bp, Homo sapiens
ccgcggccgctgccggacttcgccagatcagacccacggggctgccctcccctgcgcactcccctcgctgcccgggcccggagcgcagcgcggccgcacagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgacagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggg

SEQ ID NO: 455447 - DNA, 2117 bp, Homo sapiens
ccgcggccgctgccggacttcgccagatcagacccacggggctgccctcccctgcgcactcccctcgctgcccgggcccggagcgcagcgcggccgcacagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagtctacttctcatgtatgtgcccccagggataccaagtggtgagaagtagaacatgtcaatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggg

SEQ ID NO: 455448 - DNA, 1321 bp, Homo sapiens
cggacgcgtgggtgccaattgaaacccaggactgcactggcagcaaacaactatatctacgcaggtatagttgtatgctgccaattgaaacccaggactgcactggcaataaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggg

SEQ ID NO: 455449 - DNA, 2649 bp, Homo sapiens
ccgcggccgctgccggacttcgccagatcagacccacggggctgccctcccctgcgcactcccctcgctgcccgggcccggagcgcagcgcggccgcacagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatacattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggggatctgccatatttgtgttggtttttattttcatatccagcctaaaggtggttgtttattatatagtaataaatcattgctgtacaatatgctggtttctgtagggtatttttaattttgtcagaaattttagattgtgaatattttgtaaaaaacagtaagcaaaattttccagaattcccaaaatgaaccagatatcccctagaaaattatactattgagaaatctatggggaggatatgagaaaataaattccttctaaaccacattggaactgacctgaagaagcaaactcggaaaatataataacatccctgaattcaggacttccacaagatgcagaacaaaatggataaaaggtatttcactggagaagttttaatttctaagtaaaatttaaatcctaacacttcactaatttataactaaaatttctcatcttcgtacttgatgctcacagaggaagaaaatgatgatggtttttattcctggcatccagagtgacagtgaacttaagcaaattaccctcctacccaattctatggaatattttatacgtctccttgtttaaaatgtcactgctttactttgatgtatcatatttttaaataaaaataaatattcctttagaagatcactctaaaa

SEQ ID NO: 455450 - DNA, 1903 bp, Homo sapiens
ccgcggccgctgccggacttcgccagatcagacccacggggctgccctcccctgcgcactcccctcgctgcccgggcccggagcgcagcgcggccgcacagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattccggggacaaggcagatgaccccggggggcgcggcctgct

SEQ ID NO: 455451 - DNA, 1528 bp, Homo sapiens
ccgcggccgctgccggacttcgccagatcagacccacggggctgccctcccctgcgcactcccctcgctgcccgggcccggagcgcagcgcggccgcacagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaattgaaccggatagcttgccggcaagctatccggttcaattacctgagcccatccggaccctcaagacaactggagcccaccctgccctggaaggctcagctcccctgcttgaggacgccgcacacctgttccagaacgtgacacaggctctggtccttggcctcctgctgcccaagagatctaagctgttcgaggtaggtgtgctcctggctccaggttcctgagcctcagaggtcaggggacccttgtagaactccaccagcagcatcatctcgtgaagaatgtcagtgaccgta

SEQ ID NO: 455452 - DNA, 896 bp, Homo sapiens
  misc_feature (887)..(887): n is a, c, g, or t
ccgcggccgctgccggacttcgccagatcagacccacggggctgccctcccctgcgcactcccctcgctgcccgggcccggagcgcagcgcggccgcacagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagaattttaaattgaaatgtngattgccaa

SEQ ID NO: 455453 - DNA, 443 bp, Homo sapiens
tctagtattctactagaactggaagattgctctccgagttttgttttgttattttgtttaaaaaataaaaagcttgaggccaaggcaattcatattggctcacaggtatttttgctgtgctgtgcaaggaactctgctagctcaaggtgagtatactgggaaagccttaacgttctagagaacagagttttgcagccccacctccatcccccggggtgtgggactggggggcaggaaatgcaccgtcccctttgaaatggattactgttttttcctttcgaccccctctttctgcagcctgctttgtaggtgcagtataaaatgcacgctgaatgtcttttgtatgtaaacagcgtagcaggatggagtaacgtgaaatgcaattctacagcagtttttacgtctttgctgcctcgttcgttggctaccgagaaggttcagga

SEQ ID NO: 455454 - DNA, 260 bp, Homo sapiens
tggttgagaatggacccccgaagctgtccaatgcacagacttgtcttttgaaaaaaaagcgatagaatgttaaaccacccatctcatcatatatctaggactttagcacaaggattgttgccataagaatgaagcttttagagtgatttcttagggaatggacacaccaattaactgtctcctggccccacctttgatgttttcttcacagcaatgcactgacggatatgagtgggatcctgtgagacagcaatgcaaag

SEQ ID NO: 455455 - DNA, 2926 bp, Homo sapiens
cgaaggtagcgtgtcggggacccagactgataagacaaaagagaatcagtcgctttgggctgcccctccacacaacctgggacttttaaacaaagctgtgcgcagagaaaggcgtggaaatgccactttgagagtttgtgctgggggatgtgagaagctctgagacatgtgagaaggtctagtattctactagaactggaagattgctctccgagttttgttttgttattttgtttaaaaaataaaaagcttgaggccaaggcaattcatattggctcacaggtatttttgctgtgctgtgcaaggaactctgctagctcaagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggggatctgccatatttgtgttggtttttattttcatatccagcctaaaggtggttgtttattatatagtaataaatcattgctgtacaatatgctggtttctgtagggtatttttaattttgtcagaaattttagattgtgaatattttgtaaaaaacagtaagcaaaattttccagaattcccaaaatgaaccagatatcccctagaaaattatactattgagaaatctatggggaggatatgagaaaataaattccttctaaaccacattggaactgacctgaagaagcaaactcggaaaatataataacatccctgaattcaggacttccacaagatgcagaacaaaatggataaaaggtatttcactggagaagttttaatttctaagtaaaatttaaatcctaacacttcactaatttataactaaaatttctcatcttcgtacttgatgctcacagaggaagaaaatgatgatggtttttattcctggcatccagagtgacagtgaacttaagcaaattaccctcctacccaattctatggaatattttatacgtctccttgtttaaaatgtcactgctttactttgatgtatcatatttttaaataaaaataaatattcctttagaagatcactctaaaa

SEQ ID NO: 455456 - DNA, 3154 bp, Homo sapiens
ccgcggccgctgccggacttcgccagatcagacccacggggctgccctcccctgcgcactcccctcgctgcccgggcccggagcgcagcgcggccgcacagattcacaatgttgaaagcccttttcctaactatgctgactctggcgctggtcaagtcacaggacaccgaagaaaccatcacgtacacggtaaggggtgatggaatttgaaataagtacggttcagcgggattctgtgacaaaaaaagactttacacacccctgccagtgtatttgggctatactctgctgagggtgataaattaaacaacacttcattcatgcttcatatctaagattcgttgtaaattgcccccttgatcctttcaaaagttcattgggctcaccacctaagataggaaccaacatgtaatcatttgtgcagggctaaaaatgggatccgttcaaaaactaaaaccaaagaaagttacatgtttccaaaacattcaacaaattaatgggtgtaaggaactggaaaacctggactcctaccacatgcagataaaaccaatacgtgcagaataagactcaagtcaagtaagaacgttaaacaccataaagacacatggccttctttgtgtacatgacatgcattctcaacaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggggatctgccatatttgtgttggtttttattttcatatccagcctaaaggtggttgtttattatatagtaataaatcattgctgtacaatatgctggtttctgtagggtatttttaattttgtcagaaattttagattgtgaatattttgtaaaaaacagtaagcaaaattttccagaattcccaaaatgaaccagatatcccctagaaaattatactattgagaaatctatggggaggatatgagaaaataaattccttctaaaccacattggaactgacctgaagaagcaaactcggaaaatataataacatccctgaattcaggacttccacaagatgcagaacaaaatggataaaaggtatttcactggagaagttttaatttctaagtaaaatttaaatcctaacacttcactaatttataactaaaatttctcatcttcgtacttgatgctcacagaggaagaaaatgatgatggtttttattcctggcatccagagtgacagtgaacttaagcaaattaccctcctacccaattctatggaatattttatacgtctccttgtttaaaatgtcactgctttactttgatgtatcatatttttaaataaaaataaatattcctttagaagatcactctaaaa

SEQ ID NO: 455457 - DNA, 1779 bp, Homo sapiens
tcgagctcggccctgtttcatctggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggg

SEQ ID NO: 455458 - DNA, 1819 bp, Homo sapiens
ccgcggccgctgccggacttcgccagatcagacccacggggctgccctcccctgcgcactcccctcgctgcccgggcccggagcgcagcgcggccgcacagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggg

SEQ ID NO: 455459 - DNA, 2745 bp, Homo sapiens
  misc_feature (1877)..(1877): n is a, c, g, or t
  misc_feature (1888)..(1888): n is a, c, g, or t
  misc_feature (1898)..(1899): n is a, c, g, or t
ccgcggccgctgccggacttcgccagatcagacccacggggctgccctcccctgcgcactcccctcgctgcccgggcccggagcgcagcgcggccgcacagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattcctccctttggggnggggtttgggnaaaaaaaaanncttggatttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggggatctgccatatttgtgttggtttttattttcatatccagcctaaaggtggttgtttattatatagtaataaatcattgctgtacaatatgctggtttctgtagggtatttttaattttgtcagaaattttagattgtgaatattttgtaaaaaacagtaagcaaaattttccagaattcccaaaatgaaccagatatcccctagaaaattatactattgagaaatctatggggaggatatgagaaaataaattccttctaaaccacattggaactgacctgaagaagcaaactcggaaaatataataacatccctgaattcaggacttccacaagatgcagaacaaaatggataaaaggtatttcactggagaagttttaatttctaagtaaaatttaaatcctaacacttcactaatttataactaaaatttctcatcttcgtacttgatgctcacagaggaagaaaatgatgatggtttttattcctggcatccagagtgacagtgaacttaagcaaattaccctcctacccaattctatggaatattttatacgtctccttgtttaaaatgtcactgctttactttgatgtatcatatttttaaataaaaataaatattcctttagaagatcactctaaaa

SEQ ID NO: 455460 - DNA, 1965 bp, Homo sapiens
ccgcggccgctgccggacttcgccagatcagacccacggggctgccctcccctgcgcactcccctcgctgcccgggcccggagcgcagcgcggccgcacagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctattccactacagcctcttaaggaggacgcatataacccttaatacatgcaagggggaaagagttttactgcttgtagaaagagaaggcagtgagttttta

SEQ ID NO: 455461 - DNA, 747 bp, Homo sapiens
agttcgacggagactctccattcatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggg

SEQ ID NO: 455462 - DNA, 432 bp, Homo sapiens
ccgcggccgctgccggacttcgccagatcagacccacggggctgccctcccctgcgcactcccctcgctgcccgggcccggagcgcagcgcggccgcacaggtatttttgctgtgctgtgcaaggaactctgctagctcaagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactattgaaagcccttttcctaactatgctgactctggcgctggtcaagtcacaggacaccgaagaaaccattgcgtgtacgtgatatcacgt

SEQ ID NO: 455463 - DNA, 1158 bp, Homo sapiens
attgtgaagcgcagcccagaattattttgctggttctgccttcaaagaacttccagtccacaggtcagaaaattaattgttttggatccaaagaaacggctgactacatttcaagctctccagcatccgtgggtcacaggtaaagcagccaattttgtacacatggataccgctcaaaagaagctccaagaattcaatgcccggcgtaagcttaaggcagcggtgaaggctgtggtggcctcttcccgcctgggaagtgccagcagcagccatggcagcatccaggagagccacaaggctagccgagacccttctccaatccaagatggcaacgaggacatgaaagctattccagaaggagagaaaattcaaggcgatggggcccaagccgcagttaagggggcacaggctgagctgatgaaggtgcaagccttagagaaagttaaaggtgcagatataaatgctgaagaggcccccaaaatggtgcccaaggcagtggaggatgggataaaggtggctgacctggaactagaggagggcctagcagaggagaagctgaagactgtggaggaggcagcagctcccagagaagggcaaggaagctctgctgtgggttttgaagttccacagcaagatgtgatcctgccagagtactaaacagcttccttcagatctggaagccaaacaccggcattttatgtactttgtccttcagcaagaaaggtgtggaagcatgatatgtactatagtgattctgtttttgaggtgcaaaaaacatacatatataccagttggtaattctaacttcaatgcatgtgactgctttatgaaaataatagtgtcttctatggcatgtaatggatacctaataccgatgagttaaatcttgcaagttaacacaacgtaacacttaaaagcatacattttcagcaaccagtggcacatatttgaagtgaatagtagcaaattgtttttgctttgaaaatctagccatcctacatcctttggatttcttcacaaggcagtaattcctttgaactactgcttagctaatactaggtagtgctaaaagacatgttcccataacttttacaacattttactttttatcattgatgtgttcaaactgtttacaaggagatgcttatagatgatagt

SEQ ID NO: 455464 - DNA, 2028 bp, Homo sapiens
agcggctctctcgctcctgcgttcgcaggcggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggggtgctacatccattgtgtacagatgcaaacagaaggggacccagaagccttatgctctcaaagtgttaaagaaaacagtggacaaaaaaatcgtaagaactgagataggagttcttcttcgcctctcacatccaaacattataaaacttaaagagatatttgaaacccctacagaaatcagtctggtcctagaactcgtcacaggaggagaactgtttgataggattgtggaaaagggatattacagtgagcgagatgctgcagatgccgttaaacaaatcctggaggcagttgcttatctacatgaaaatgggattgtccatcgtgatctcaaaccagagaatcttctttatgcaactccagccccagatgcaccactcaaaatcgctgattttggactctctaaaattgtggaacatcaagtgctcatgaagacagtatgtggaaccccagggtactgcgcacctgaaattcttagaggttgtgcctatggacctgaggtggacatgtggtctgtaggaataatcacctacatcttactttgtggatttgaaccattctatgatgaaagaggcgatcagttcatgttcaggagaattctgaattgtgaatattactttatctccccctggtgggatgaagtatctctaaatgccaaggacttggtcagaaaattaattgttttggatccaaagaaacggctgactacatttcaagctctccagcatccgtgggtcacaggtaaagcagccaattttgtacacatggataccgctcaaaagaagctccaagaattcaatgcccggcgtaagcttaaggcagcggtgaaggctgtggtggcctcttcccgcctgggaagtgccagcagcagccatggcagcatccaggagagccacaaggctagccgagacccttctccaatccaagatggcaacgaggacatgaaagctattccagaaggagagaaaattcaaggcgatggggcccaagccgcagttaagggggcacaggctgagctgatgaaggtgcaagccttagagaaagttaaaggtgcagatataaatgctgaagaggcccccaaaatggtgcccaaggcagtggaggatgggataaaggtggctgacctggaactagaggagggcctagcagaggagaagctgaagactgtggaggaggcagcagctcccagagaagggcaaggaagctctgctgtgggttttgaagttccacagcaagatgtgatcctgccagagtactaaacagcttccttcagatctggaagccaaacaccggcattttatgtactttgtccttcagcaagaaaggtgtggaagcatgatatgtactatagtgattctgtttttgaggtgcaaaaaacatacatatataccagttggtaattctaacttcaatgcatgtgactgctttatgaaaataatagtgtcttctatggcatgtaatggatacctaataccgatgagttaaatcttgcaagttaacacaacgtaacacttaaaagcatacattttcagcaaccagtggcacatatttgaagtgaatagtagcaaattgtttttgctttgaaaatctagccatcctacatcctttggatttcttcacaaggcagtaattcctttgaactactgcttagctaatactaggtagtgctaaaagacatgttcccataacttttacaacattttactttttatcattgatgtgttcaaactgtttacaaggagatgcttatagatgatagt

SEQ ID NO: 455465 - DNA, 2517 bp, Homo sapiens
agcggctctctcgctcctgcgttcgcaggcggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggggtgctacatccattgtgtacagatgcaaacagaaggggacccagaagccttatgctctcaaagtgttaaagaaaacagtggacaaaaaaatcgtaagaactgagataggagttcttcttcgcctctcacatccaaacattataaaacttaaagagatatttgaaacccctacagaaatcagtctggtcctagaactcgtcacaggaggagaactgtttgataggattgtggaaaagggatattacagtgagcgagatgctgcagatgccgttaaacaaatcctggaggcagttgcttatctacatgaaaatgggattgtccatcgtgatctcaaaccagagaatcttctttatgcaactccagccccagatgcaccactcaaaatcgctgattttggactctctaaaattgtggaacatcaagtgctcatgaagacagtatgtggaaccccagggtactgcgcacctgaaattcttagaggttgtgcctatggacctgaggtggacatgtggtctgtaggaataatcacctacatcttactttgtggatttgaaccattctatgatgaaagaggcgatcagttcatgttcaggagaattctgaattgtgaatattactttatctccccctggtgggatgaagtatctctaaatgccaaggacttggtcagaaaattaattgttttggatccaaagaaacggctgactacatttcaagctctccagcatccgtgggtcacaggtaaagcagccaattttgtacacatggataccgctcaaaagaagctccaagaattcaatgcccggcgtaagcttaaggcagcggtgaaggctgtggtggcctcttcccgcctgggaagtgccagcagcagccatggcagcatccaggagagccacaaggctagccgagacccttctccaatccaagatggcaacgaggacatgaaagctattccagaaggagagaaaattcaaggcgatggggcccaagccgcagttaagggggcacaggctgagctgatgaaggtgcaagccttagagaaagttaaaggtgcagatataaatgctgaagaggcccccaaaatggtgcccaaggcagtggaggatgggataaaggtggctgacctggaactagaggagggcctagcagaggagaagctgaagactgtggaggaggcagcagctcccagagaagggcaaggaagctctgctgtgggttttgaagttccacagcaagatgtgatcctgccagagtactaaacagcttccttcagatctggaagccaaacaccggcattttatgtactttgtccttcagcaagaaagaggtccaccagggcaaaatagaagccttgccgagaaagtgaactgtcttactccttcaaaggaatcagatgttgctctagagaagactccaggcatctacctggttgagctcaaatgaggcaagtgggagaaaacctcttctcatcctctgattgaaagtgatacaatttgaatattggtatattgtcattggtcagtaatggaaaaatgagattcccacccagtgggttactcttttccttgtcttggtttgctatgccttatcccagatcagtgttttgttccatccctatggtcatctctaaagccctgacaggagcatcccagactggagaaatgcagcgtatctgtggcccagaattttgtttgatactctaaacagcaatgcaaagactgcaaaatcacactattctaaacagttgttttcagctcattttgaagattgacctggaaaacatatagatacagaatatatacatttaatcgttgcttgtgattcattgtgtcaaaataacatttaattttcactctgattaatctttattttccatttaaaagattatttcaggctacttaaatacaagaccttgcattctaatttttgaaagcggttgttttccctgagctctctctcaactttgacagtttgtgaatgataaaaagttactaggtttgtcctttccttgatagatgtagagcagttcatctgttttgtaaaggtacagttaagcataactataggctgggcgtgatagttcatgcctgtaatcccaacactttgggaggccgaggttggcagatcacctgaggtcaggagtttgagaccagcctggccaacgtggtgaaacccctaatacaaaaattagctgggcatggtggcacgctcctgtaatctcagctactcaggaggctgaggcaggagaa

SEQ ID NO: 455466 - DNA, 5027 bp, Homo sapiens
cgggattcggctggctctgccacaccaccgcgcgcccccgctccgcccgcccctccgggcgcgtcttttccgggctcgcgctgagtcccgcctccgccggctgtccgggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccgattgaaatcacagaagatattcgtgttcttcttaagagaaaaagaggacatttaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatgaactatcttgaagtgaatcgcagagtgaataactttggtagtggactcactgcactgggactaaaaccaaagaacaccattgccatcttctgtgagaccagggccgaatggatgattgcagcacagacctgctttaagtacaactttcctcttgtgactttatatgccacacttggcaaagaagcagtagttcatgggctaaatgaatctgaggcttcctatctgattaccagtgttgaacttctggaaagtaaacttaagactgcattgttagatatcagttgtgttaaacatatcatttatgtggacaataaggctatcaataaagcagagtaccctgaaggatttgagattcacagcatgcaatcagtagaagagttgggatctaacccagaaaacttgggcattcctccaagtagaccaacgccttcagacatggccattgttatgtatactagtggttctactggccgacctaagggagtgatgatgcatcatagcaatttgatagctggaatgacaggccagtgtgaaagaatacctggactgggaccgaaggacacatatattggctacttgcctttggctcatgtgctagaactgacagcagagatatcttgctttacctatggctgcaggattggatattcttctccgcttacactctctgaccagtccagcaaaattaaaaaaggaagcaaaggagactgtactgtactgaagcccacacttatggctgctgttccggaaatcatggatagaatttataagaatgttatgagcaaagtccaagagatgaattatattcagaaaactctgttcaagatagggtatgattacaaattggaacagatcaaaaagggatatgatgcacctctttgcaatctgttactgtttaaaaaggtcaaggccctgctgggagggaatgtccgcatgatgctgtctggaggggccccgctatctcctcagacacaccgattcatgaatgtctgcttctgctgcccaattggccagggttatggactgacagaatcatgtggtgctgggacagttactgaagtaactgactatactactggcagagttggagcacctcttatttgctgtgaaattaagctaaaagactggcaagaaggcggttatacaattaatgacaagccaaaccccagaggtgaaatcgtaattggtggacagaacatctccatgggatattttaaaaatgaagagaaaacagcagaagattattctgtggatgaaaatggacaaaggtggttttgcactggtgatattggagaattccatcccgatggatgtttacagattatagatcgtaagaaagatctagtgaagttacaagcaggagagtatgtatctcttgggaaagtagaagctgcactgaagaattgtccacttattgacaacatctgtgcttttgccaaaagtgatcagtcctatgtgatcagttttgtggttcctaaccagaaaaggttgacacttttggcacaacagaaaggggtagaaggaacttgggttgatatctgcaataatcctgctatggaagctgaaatactgaaagaaattcgagaagctgcaaatgccatgaaattggagcgatttgaaattccaatcaaggttcgattaagcccagagccatggacccctgaaactggtttggtaactgatgctttcaaactgaaaaggaaggagctgaggaaccattacctcaaagacattgaacgaatgtatgggggcaaataaaatgttgttgtcttattgacagttgtgcaggaggtagcctggtggttttcaacctctagaattttaagcctttgttgaactgttagaatgtaaggtatatcattctaaagatagagtaaaaagaaaacaaaaccaaaagttattaaaattgttgtccggtttactttaacttagttttgcatagttctagtgcagctgaaattgaaaagttatttccctttagctgtgttattatagagcagaaattctgtttttaaaaattagcctaagatatacttgtttttgtaaagaaaaatatttaatgttgaacaaaataaattggagttggagtagaatgtagtttgaggaaatttgcagcttccaatgcctcttgtcttcctatttcagaagtttaaatattaagcatgacagaaaatatgtattaacactactcaaagcaaaagtgctgcagggctttaaaattctcttccaaccatttatcttgaaggaaaaattcaatagtaatataatacacaaaatcaaataataccttagaaggtattaagattataattgttgcataggttagatatagagtcattgtaatgttgtgaataattacagtgcctaaaataagaatagaacaacatatacaacaccaaaaaatatctagtaatatatttaaagggaaattgagctgctttttttgaaactttgagatctaaaaataactgtaattatttgaatgactaagaggaaagtacattttttgaaatgctgaaaattgcctttctgtgtttattcaaactgaaaagctgagaccaagagcaaggaaggtaaaaagttaacaggcaaacattttctcttagaaaaggtgataaaatcataagtatttggaattagaacccttgcacagcactgaacctgggaaagagatttaaactctgaatttatctttgataacagggattgattttaaaatgtacatgtattaaattacatttgtaatttaaggtctgtttgctgttgctgattttattcttgatcagtagtttgcatttcagaaagcctttcattttgctttaattttagcaaagcgggttataatgaatgacttccccaatatcttgcttgaacttacaggtgattaacttggatgagttttgggaagttaaagggaagaaaacactgttatcattttttcctgtttgggaagagcttagaaactggaaatactagatttgggagaagggcagagttacttgataagggactgatgtttgtgcagtaacttgggagtgtggtttctttttgaatctttaattaaaacctgggattatatatccctgataaatattcacacttgaaccatagttactgtaaaatgcaaaaaatcttaatactgttattctttgcactttttcttaatcattttttatatatatgcatatatatatgtgtgtgtgtgtgttgcttatgttgttttgtacagatgtgggccaccattgcaacaaaatacattctttttgctctaaaatatttatgaagaaaatacttaaatgttatgtatatggtggtaataagggaaaaatcaagtattataaacaagaatgaaggtttttgtaaagatttctgttcagcgttttgcaaggtaaaattttaggcaagttttccctgaagttatgtgtatgtgagtattctcattcttcccaacttgcctttgaagagtgaaataccattattatcaagtagactactgttcagcttttattcctgccctgctgtttatcccttaagaatgagtttcttagacttttccaatatgtgattttttttcccatttagaatggtgattttaaatgtgtgagtgcatgtactatcttatctcagatatttgcacccccaatctgcccccaactcccaaaagctagaacactgccaactgatctgttataggtcctttagaaacacataattaacacttaaggttgggtgctgctaattctttgcaaaaatccaaatattgttaagggaccagggagatgccactaccccttgattttccatctaaaaatatacatgtttatgtaaacaaatctttccatatccatagtgacttttcaagtatttaagcctaaagattttgatctcacatttttatacctgtttaaattgctcacagttattacatacacatcagccatcaactaaagttgtactttaaaaatttactacaatatgtacatttctaagtcaaacacttgtgacttttgctttaattccatgaatgttcctgcctccttgatatttgtatttattctttttttctctagagtagaggtataattgtgtgatatttcagaaatacagataaatgattcaaaaagtcacagttaaggagaatcatgtttctttgatcatgaataactgattagtaagtcttgcctatattttcctgatagcatatgacaaatgtttctaaggtaacaagatgagaacagataaagattgtgtggtgttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatcaa

SEQ ID NO: 455467 - DNA, 4973 bp, Homo sapiens
cgggattcggctggctctgccacaccaccgcgcgcccccgctccgcccgcccctccgggcgcgtcttttccgggctcgcgctgagtcccgcctccgccggctgtccgggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccgattgaaatcacagaagatattcgtgttcttcttaagagaaaaagaggacatttaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatgaactatcttgaagtgaatcgcagagtgaataactttggtagtggactcactgcactgggactaaaaccaaagaacaccattgccatcttctgtgagaccagggccgaatggatgattgcagcacagacctgctttaagtacaactttcctcttgtgactttatatgccacacttggcaaagaagcagtagttcatgggctaaatgaatctgaggcttcctatctgattaccagtgttgaacttctggaaagtaaacttaagactgcattgttagatatcagttgtgttaaacatatcatttatgtggacaataaggctatcaataaagcagagtaccctgaaggatttgagattcacagcatgcaatcagtagaagagttgggatctaacccagaaaacttgggcattcctccaagtagaccaacgccttcagacatggccattgttatgtatactagtggttctactggccgacctaagggagtgatgatgcatcatagcaatttgatagctggaatgacaggccagtgtgaaagaatacctggactgggaccgaaggacacatatattggctacttgcctttggctcatgtgctagaactgacagcagagatatcttgctttacctatggctgcaggattggatattcttctccgcttacactctctgaccagtccagcaaaattaaaaaaggaagcaaaggagactgtactgtactgaagcccacacttatggctgctgttccggaaatcatggatagaatttataagaatgttatgagcaaagtccaagagatgaattatattcagaaaactctgttcaagatagggtatgattacaaattggaacagatcaaaaagggatatgatgcacctctttgcaatctgttactgtttaaaaaggtcaaggccctgctgggagggaatgtccgcatgatgctgtctggaggggccccgctatctcctcagacacaccgattcatgaatgtctgcttctgctgcccaattggccagggttatggactgacagaatcatgtggtgctgggacagttactgaagtaactgactatactactggcagagttggagcacctcttatttgctgtgaaattaagctaaaagactggcaagaaggcggttatacaattaatgacaagccaaaccccagaggtgaaatcgtaattggtggacagaacatctccatgggatattttaaaaatgaagagaaaacagcagaagattattctgtggatgaaaatggacaaaggtggttttgcactggtgatattggagaattccatcccgatggatgtttacagattatagatcgtaagaaagatctagtgaagttacaagcaggagagtatgtatctcttgggaaagtagaagctgcactgaagaattgtccacttattgacaacatctgtgcttttgccaaaagtgatcagtcctatgtgatcagttttgtggttcctaaccagaaaaggttgacacttttggcacaacagaaaggggtagaaggaacttgggttgatatctgcaataatcctgctatggaagctgaaatactgaaagaaattcgagaagctgcaaatgccatgaaattggagcgatttgaaattccaatcaaggttcgattaagcccagagccatggacccctgaaactggtttggtaactgatgctttcaaactgaaaaggaaggagctgaggaaccattacctcaaagacattgaacgaatgtatgggggcaaataaaatgttgttgtcttattgacagttgtgcaggaggtagcctggtggttttcaacctctagaattttaagcctttgttgaactgttagaatgtaaggtatatcattctaaagatagagtaaaaagaaaacaaaaccaaaagttattaaaattgttgtccggtttactttaacttagttttgcatagttctagtgcagctgaaattgaaaagttatttccctttagctgtgttattatagagcagaaattctgtttttaaaaattagcctaagatatacttgtttttgtaaagaaaaatatttaatgttgaacaaaataaattggagttggagtagaatgtagtttgaggaaatttgcagcttccaatgcctcttgtcttcctatttcagaagtttaaatattaagcatgacagaaaatatgtattaacactactcaaagcaaaagtgctgcagggctttaaaattctcttccaaccatttatcttgaaggaaaaattcaatagtaatataatacacaaaatcaaataataccttagaaggtattaagattataattgttgcataggttagatatagagtcattgtaatgttgtgaataattacagtgcctaaaataagaatagaacaacatatacaacaccaaaaaatatctagtaatatatttaaagggaaattgagctgctttttttgaaactttgagatctaaaaataactgtaattatttgaatgactaagaggaaagtacattttttgaaatgctgaaaattgcctttctgtgtttattcaaactgaaaagctgagaccaagagcaaggaaggtaaaaagttaacaggcaaacattttctcttagaaaaggtgataaaatcataagtatttggaattagaacccttgcacagcactgaacctgggaaagagatttaaactctgaatttatctttgataacagggattgattttaaaatgtacatgtattaaattacatttgtaatttaaggtctgtttgctgttgctgattttattcttgatcagtagtttgcatttcagaaagcctttcattttgctttaattttagcaaagcgggttataatgaatgacttccccaatatcttgcttgaacttacaggtgattaacttggatgagttttgggaagttaaagggaagaaaacactgttatcattttttcctgtttgggaagagcttagaaactggaaatactagatttgggagaagggcagagttacttgataagggactgatgtttgtgcagtaacttgggagtgtggtttctttttgaatctttaattaaaacctgggattatatatccctgataaatattcacacttgaaccatagttactgtaaaatgcaaaaaatcttaatactgttattctttgcactttttcttaatcattttttatatatatgcatatatatatgtgtgtgtgtgtgttgcttatgttgttttgtacagatgtgggccaccattgcaacaaaatacattctttttgctctaaaatatttatgaagaaaatacttaaatgttatgtatatggtggtaataagggaaaaatcaagtattataaacaagaatgaaggtttttgtaaagatttctgttcagcgttttgcaagcttcccaacttgcctttgaagagtgaaataccattattatcaagtagactactgttcagcttttattcctgccctgctgtttatcccttaagaatgagtttcttagacttttccaatatgtgattttttttcccatttagaatggtgattttaaatgtgtgagtgcatgtactatcttatctcagatatttgcacccccaatctgcccccaactcccaaaagctagaacactgccaactgatctgttataggtcctttagaaacacataattaacacttaaggttgggtgctgctaattctttgcaaaaatccaaatattgttaagggaccagggagatgccactaccccttgattttccatctaaaaatatacatgtttatgtaaacaaatctttccatatccatagtgacttttcaagtatttaagcctaaagattttgatctcacatttttatacctgtttaaattgctcacagttattacatacacatcagccatcaactaaagttgtactttaaaaatttactacaatatgtacatttctaagtcaaacacttgtgacttttgctttaattccatgaatgttcctgcctccttgatatttgtatttattctttttttctctagagtagaggtataattgtgtgatatttcagaaatacagataaatgattcaaaaagtcacagttaaggagaatcatgtttctttgatcatgaataactgattagtaagtcttgcctatattttcctgatagcatatgacaaatgtttctaaggtaacaagatgagaacagataaagattgtgtggtgttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatcaa
